United States Patent
Waldor et al.

(10) Patent No.: US 11,484,585 B2
(45) Date of Patent: Nov. 1, 2022

(54) LIVE ATTENUATED CHOLERA VACCINE WITH PROBIOTIC PROPERTIES

(71) Applicant: The Brigham and Women's Hospital, Inc., Boston, MA (US)

(72) Inventors: Matthew K. Waldor, Newton, MA (US); Troy Hubbard, Boston, MA (US); Gabriel Billings, Somerville, MA (US)

(73) Assignee: The Brigham and Women's Hospital, Inc., Boston, MA (US)

( * ) Notice: Subject to any disclaimer, the term of this patent is extended or adjusted under 35 U.S.C. 154(b) by 0 days.

(21) Appl. No.: 16/629,898

(22) PCT Filed: Jul. 12, 2018

(86) PCT No.: PCT/US2018/041846
§ 371 (c)(1),
(2) Date: Jan. 9, 2020

(87) PCT Pub. No.: WO2019/014462
PCT Pub. Date: Jan. 17, 2019

(65) Prior Publication Data
US 2020/0268868 A1    Aug. 27, 2020

Related U.S. Application Data

(60) Provisional application No. 62/680,286, filed on Jun. 4, 2018, provisional application No. 62/531,551, filed on Jul. 12, 2017.

(51) Int. Cl.
| | | |
|---|---|---|
| *A61K 39/106* | (2006.01) |
| *A01N 63/00* | (2020.01) |
| *A61K 48/00* | (2006.01) |
| *A61K 39/02* | (2006.01) |
| *A61P 1/12* | (2006.01) |
| *A61P 31/04* | (2006.01) |
| *C12N 9/22* | (2006.01) |
| *C12N 15/11* | (2006.01) |
| *C12N 1/20* | (2006.01) |
| *A61K 39/00* | (2006.01) |
| *C12R 1/63* | (2006.01) |

(52) U.S. Cl.
CPC .............. *A61K 39/107* (2013.01); *A61P 1/12* (2018.01); *A61P 31/04* (2018.01); *C12N 1/205* (2021.05); *C12N 9/22* (2013.01); *C12N 15/11* (2013.01); *A61K 2039/522* (2013.01); *C12N 2800/80* (2013.01); *C12R 2001/63* (2021.05)

(58) Field of Classification Search
CPC .................................................. A61K 39/107
See application file for complete search history.

(56) References Cited

U.S. PATENT DOCUMENTS

2015/0064138 A1 *   3/2015   Lu ..................... A61K 38/465
                                                         424/93.2

FOREIGN PATENT DOCUMENTS

| WO | WO01/68829 | * | 9/2001 |
| WO | WO 2001/068829 | | 9/2001 |
| WO | WO 2016/040030 | | 3/2016 |
| WO | WO 2016/113322 | | 7/2016 |
| WO | WO 2016/177682 | | 11/2016 |

OTHER PUBLICATIONS

Hoppner, Horm Re. 2002, 58 Suppl. 3:7-15 (Year: 2002).*
Lodish et al., Mol. Cell Biol., 3rd ed. Scientific American Books, NY, 1995 (Year: 1995).*
John et al., Infection and Immunity, 2000; 68(3): 1171-1175 (Year: 2000).*
EP Extended Search Report in European Appln. No. 18832883.0, dated Jun. 1, 2021, 13 pages.
Abel et al., "Analysis of bottlenecks in experimental models of infection," PLoS Pathogens, Jun. 2015, 11(6).
Abel et al., "Sequence tag-based analysis of microbial population dynamics," Nature Methods, Mar. 2015, 12(3):223-6.
Aktar et al., "O-specific polysaccharide-specific memory B cell responses in young children, older children, and adults infected with Vibrio cholerae O1 Ogawa in Bangladesh" Clinical and Vaccine Immunology, May 1, 2016. 23(5):427-35.
Ali et al., "Updated global burden of cholera in endemic countries," PLoS Neglected Tropical Diseases, Jun. 2015, 9(6).
Azman et al., "The impact of a one-dose versus two-dose oral cholera vaccine regimen in outbreak settings: a modeling study," PLoS Medicine, Aug. 25, 2015, 12(8).
Azman et al., "The incubation period of cholera: a systematic review," Journal of Infection, May 1, 2013, 66(5):432-8.
Balakrishnan, "Cholera in Yemen," The Lancet Infectious Diseases, Jul. 2017, 17(7):700.
Bashir et al., "A hybrid approach for the automated finishing of bacterial genomes," Nature Biotechnology. Jul. 2012, 30(7):701.
Böhles et al., "Vaccines against human diarrheal pathogens: current status and perspectives," Human Vaccines & Immunotherapeutics, Jun. 4, 2014, 10(6):1522-35.
Butterton et al., "Heterologous antigen expression in Vibrio cholerae vector strains," Infection and Immunity, Jul. 1, 1995, 63(7):2689-96.
Calain et al., "Can oral cholera vaccination play a role in controlling a cholera outbreak?," Vaccine. Jun. 23, 2004, 22(19):2444-51.
Chao et al., "The design and analysis of transposon insertion sequencing experiments," Nature Reviews Microbiology, Feb. 2016, 14(2):119.

(Continued)

*Primary Examiner* — Gary B Nickol
*Assistant Examiner* — Lakia J Jackson-Tongue
(74) *Attorney, Agent, or Firm* — Fish & Richardson P.C.

(57) ABSTRACT

Provided herein are genetically engineered *Vibrio cholerae* bacterial strains, compositions including the bacterial strains, and methods of using the same for the prevention of *Vibrio cholerae* infection in a subject.

20 Claims, 14 Drawing Sheets

Figure 1:
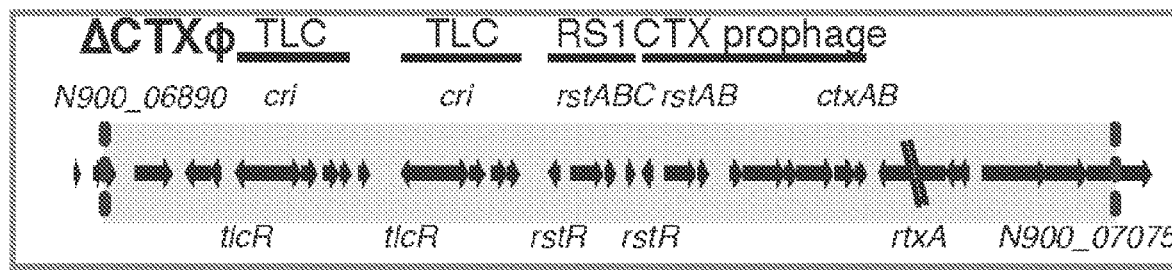

Specification includes a Sequence Listing.

(56) References Cited

OTHER PUBLICATIONS

Chen et al., "Single-dose live oral cholera vaccine CVD 103-HgR protects against human experimental infection with Vibrio cholerae O1 El Tor," Clinical Infectious Diseases, Jun. 1, 2016, 62(11):1329-35.
Chiang et al., "Construction of a mariner-based transposon for epitope-tagging and genomic targeting," Gene, Aug. 21, 2002, 296(1-2):179-85.
Chin et al., "The origin of the Haitian cholera outbreak strain," New England Journal of Medicine, Jan. 6, 2011, 364(1):33-42.
Clements et al., "Cholera," The Lancet, Mar. 13, 2017, 390, 1539-49.
Cohen et al., "Randomized, controlled human challenge study of the safety, immunogenicity, and protective efficacy of a single dose of Peru-15, a live attenuated oral cholera vaccine," Infection and Immunity, Apr. 1, 2002, 70(4):1965-70.
Duan et al., "Engineered bacterial communication prevents Vibrio cholerae virulence in an infant mouse model," Proceedings of the National Academy of Sciences, Jun. 22, 2010, 107(25):11260-4.
Farmer et al., "Meeting cholera's challenge to Haiti and the world: a joint statement on cholera prevention and care," PLoS Neglected Tropical Diseases, May 2011, 5(5), 13 pages.
Ferrieres et al., "Silent mischief: bacteriophage Mu insertions contaminate products of *Escherichia coli* random mutagenesis performed using suicidal transposon delivery plasmids mobilized by broad-host-range RP4 conjugative machinery," Journal of Bacteriology, Dec. 15, 2010, 192(24):6418-27.
Fullner et al., "The contribution of accessory toxins of Vibrio cholerae O1 El Tor to the proinflammatory response in a murine pulmonary cholera model." The Journal of Experimental Medicine, Jun. 3, 2002, 195(11):1455-62.
Gavin et al., "MARTX toxins as effector delivery platforms," Pathogens and Disease, Dec. 1, 2015, 73(9).
GenBank: CP006947.1. "Vibrio cholerae 01 str. KW3 chromosome I, complete sequence," updated Oct. 16, 2015, 2 pages.
Hill et al., "The International Scientific Association for Probiotics and Prebiotics consensus statement on the scope and appropriate use of the term probiotic," Nature Reviews Gastroenterology & Hepatology, Aug. 2014, 11(8):506-14.
Hsiao et al., "Members of the human gut microbiota involved in recovery from Vibrio cholerae infection," Nature, Nov. 2014, 515(7527):423-6.
Jackson et al., "Seroepidemiologic survey of epidemic cholera in Haiti to assess spectrum of illness and risk factors for severe disease," The American Journal of Tropical Medicine and Hygiene, Oct. 9, 2013, 89(4):654-64.
John et al., "In Vitro and In Vivo Analyses of Constitutive and In Vivo-Induced Promoters in Attenuated Vaccine and Vector Strains of Vibrio cholerae," Infection and Immunity, Mar. 1, 2000, 68(3):1171-5.
Kabir, "Critical analysis of compositions and protective efficacies of oral killed cholera vaccines." Clin. Vaccine Immunol. Sep. 1, 2014, 21(9):1195-205.
Kamp et al., "Gene fitness landscapes of Vibrio cholerae at important, stages of its life cycle," PLoS Pathogens, Dec. 2013, 9(12).
Kamruzzaman et al., "RS1 satellite phage promotes diversity of toxigenic Vibrio cholerae by driving CTX prophage loss and elimination of lysogenic immunity." Infection and Immunity, Sep. 1, 2014, 82(9):3636-43.
Kauffman et al., "Single-cell analysis of the plasmablast response to Vibrio cholerae demonstrates expansion of cross-reactive memory B cell," Mbio, Dec. 30, 2016, 7(6):e02021-16.
Kenner et al., "Peru-15, an improved live attenuated oral vaccine candidate for Vibrio cholerae O1." Journal of Infectious Diseases, Oct. 1, 1995, 172(4):1126-9.
Kim et al., "CTX prophages in Vibrio cholerae O1 strains." Journal of Microbiological Biotechnology, Jun. 2014, 24(6):725-31.
Lazar et al., "ToxR-independent expression of cholera toxin from the replicative form of CTXΦ," Infection and Immunity, Jan. 1, 1998, 66(1):394-7.
Luquero et al., "Use of Vibrio cholerae vaccine in an outbreak in Guinea," New England Journal of Medicine, May 29, 2014, 370(22):2111-20.
Martinez et al., "CTXφ replication depends on the histone-like HU protein and the UvrD helicase," PLoS Genetics, May 2015, 11(5).
Matias et al., "Antibody secreting cell responses following vaccination with bivalent oral cholera vaccine among haitian adults," PLoS Neglected Tropical Diseases, Jun. 2016, 10(6).
McLeod et al., "CTXφ and Vibrio cholerae: exploring a newly recognized type of phage-host cell relationship," Molecular Microbiology, Jul. 2005, 57(2):347-56.
Millet et al., "Insights into Vibrio cholerae intestinal colonization from monitoring fluorescently labeled bacteria," PLoS Pathogens, Oct. 2014, 10(10).
Olivier et al., Successful small intestine colonization of adult mice by Vibrio cholerae requires ketamine anesthesia and accessory toxins, PloS One, Oct. 2009. 4(10).
PCT International Preliminary Report on Patentability in International Appln. No. PCT/US18/41846, dated Jan. 14, 2020, 11 pages.
PCT International Search Report and Written Opinion in International Appln. No. PCT/US18/41846, dated Dec. 4, 2018, 16 pages.
Pritchard et al., "Artist: high-resolution genome-wide assessment of fitness using transposon-insertion sequencing," PLoS Genetics. Nov. 2014, 10(11).
Qadri et al., "Feasibility and effectiveness of oral cholera vaccine in an urban endemic setting in Bangladesh: a cluster randomised open-label trial," The Lancet, Oct. 3, 2015, 386(10001):1362-71.
Qadri et al.. "Peru-15, a live attenuated oral cholera vaccine, is safe and immunogenic in Bangladeshi toddlers and infants," Vaccine, Jan. 4, 2007, 25(2):231-8.
Reyburn et al., "The case for reactive mass oral cholera vaccinations," PLoS Neglected Tropical Diseases, Jan. 2011, 5(1).
Ritchie et al., "Back to the future: studying cholera pathogenesis using infant rabbits," Mbio. May 18, 2010, 1(1):e00047-10.
Rollenhagen et al., "Transcutaneous immunization with a synthetic hexasaccharide-protein conjugate induces anti-Vibrio cholerae lipopolysaccharide responses in mice," Vaccine, Aug. 6, 2009, 27(36):4917-22.
Rui et al., "Reactogenicity of live-attenuated Vibrio cholerae vaccines is dependent on flagellins," Proceedings of the National Academy of Sciences, Mar. 2, 2010, 107(9):4359-64.
Rutherford et al., "Bacterial quorum sensing: its role in virulence and possibilities for its control," Cold Spring Harbor Perspectives in Medicine, Nov. 1, 2012, 2(11):a012427.
Satchell, "Multifunctional-autoprocessing repeats-in-toxin (MARTX) Toxins of Vibrios," Microbiology Spectrum. Jun. 2015, 3(3).
Tarique et al., "Transcutaneous immunization with a Vibrio cholerae O1 Ogawa synthetic hexasaccharide conjugate following oral whole-cell cholera vaccination boosts vibriocidal responses and induces protective immunity in mice." Clin. Vaccine Immunol, Apr. 1, 2012, 19(4):594-602.
Thompson et al., "Use of recA as an alternative phylogenetic marker in the family Vibrionaceae," International Journal of Systematic and Evolutionary Microbiology, May 1, 2004, 54(3):919-24.
Waldor et al., "Lysogenic conversion by a filamentous phage encoding cholera toxin," Science, Jun. 28, 1996, 272(5270):1910-4.
Weil et al., "Clinical outcomes in household contacts of patients with cholera in Bangladesh," Clinical Infectious Diseases, Nov. 15, 2009, 49(10):1473-9.
Zhu et al., "Quorum-sensing regulators control virulence gene expression in Vibrio cholerae." Proceedings of the National Academy of Sciences. Mar. 5, 2002, 99(5):3129-34.
Bikard et al., "Exploiting CRISPR-Cas nuclease to produce sequence-specific antimicrobials," Nature Biotechnology, No. 2014, 32(11):1146-50.
Davis et al., "Filamentous phages linked to virulence of Vibrio cholerae," Current Opinion in Microbiology, Feb. 1, 2003, 6(1):35-42.
EP European Search Report in European Appln. No. 18832833.0, dated Mar. 1, 2021, 8 pages.

(56) References Cited

OTHER PUBLICATIONS

JP Japanese Office Action in Japanese Appln. No. 2020-501328, dated Jul. 26, 2022, 10 pages (with English translation).
Mahmoudi et al., "Malaria vaccine development: The need for novel approaches: A review article," Iranian Journal of Parasitology, Jan. 2018, 13(1).1.

* cited by examiner

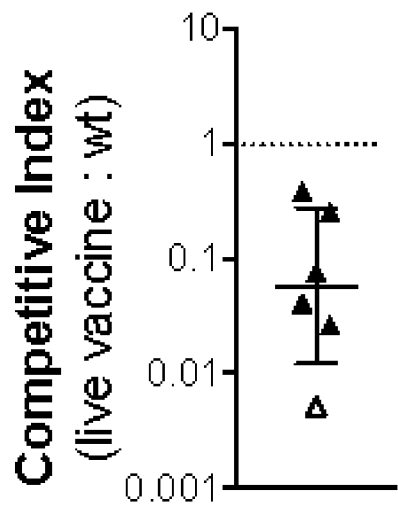
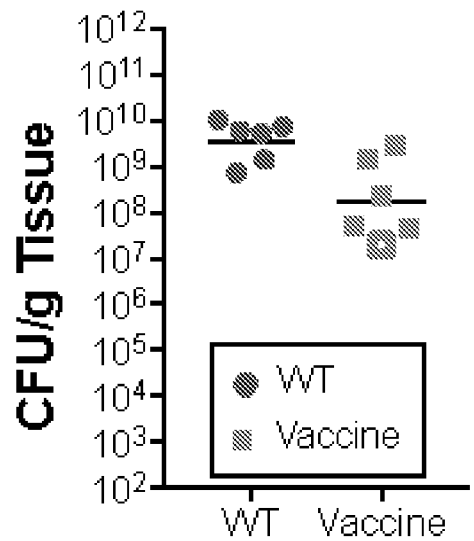
FIG. 4D  FIG. 4E
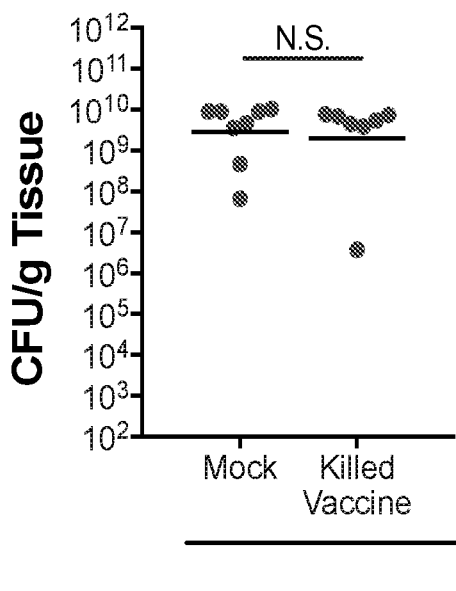
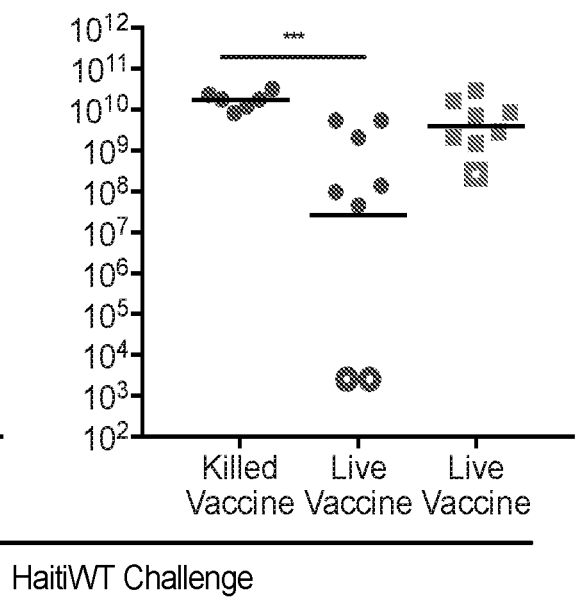
FIG. 5A  FIG. 5B

Sequential Inoculation: killed vaccine / live vaccine followed by wild type

Single Inoculation: transposon mutant library

Sequential Inoculation: live vaccine followed by transposon mutant library

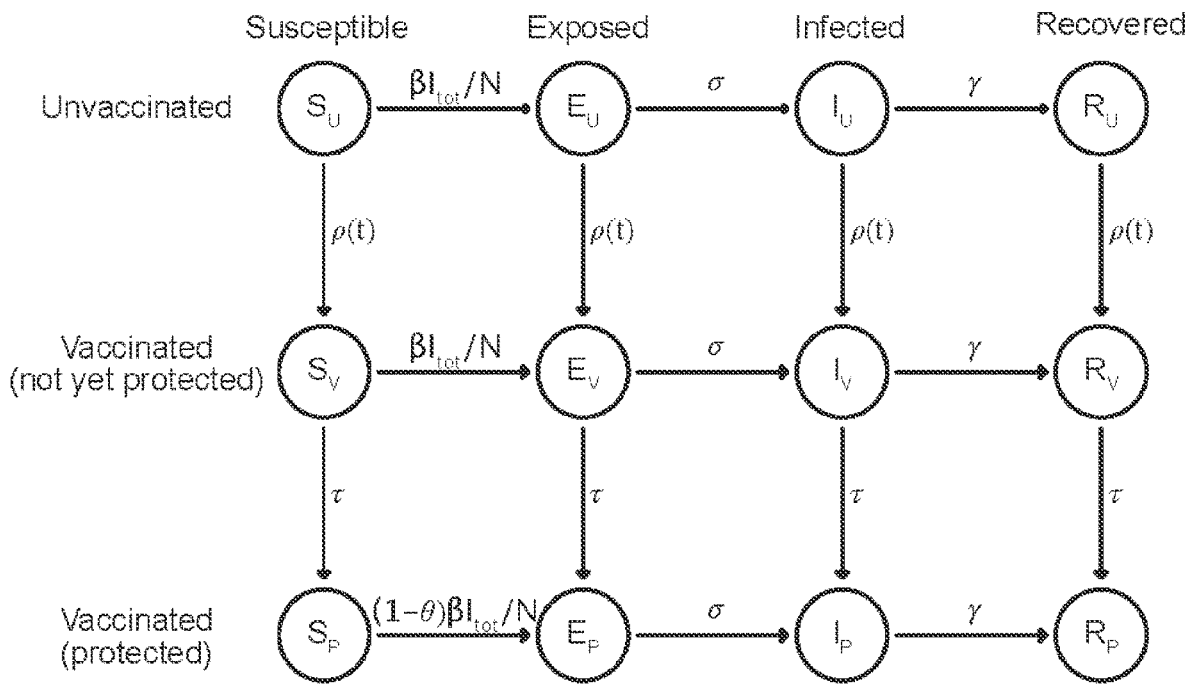

FIG. 10A

| Parameter description | Symbol | Value |
|---|---|---|
| Transmission parameter | β | 0.5-2.5 /day |
| Mean incubation period | 1/σ | 1.4 days |
| Mean period of infectiousness | 1/γ | 2 days |
| Time-dependent rate of vaccination | ρ(t) | See text |
| Mean time to protection | 1/τ | 1 day (fast vaccine) or 10 days (slow vaccine) |
| Vaccine efficacy | θ | 0.7 |
| Population size | N | 100000 |
| Fraction of population vaccinated | | 0.7 |
| Duration of vaccination campaign | | 1-21 days |
| Vaccination campaign triggering threshold (number of symptomatic cases) | | 100-10,000 |
| Fraction of infections that are symptomatic | | 0.25 |

FIG. 10B

LIVE ATTENUATED CHOLERA VACCINE WITH PROBIOTIC PROPERTIES

CROSS REFERENCE TO RELATED APPLICATIONS

This application is a national stage application of PCT/US2018/041846, filed Jul. 12, 2018, which claims the benefit of priority of U.S. Application No. 62/531,551, filed Jul. 12, 2017; and U.S. Application No. 62/680,286, filed Jun. 4, 2018. The content of each of the foregoing applications is hereby incorporated by reference in its entirety.

FEDERALLY SPONSORED RESEARCH OR DEVELOPMENT

This invention was made with Government support under Grant Nos. AI042347 and AI-120665, awarded by the National Institutes of Health. The Government has certain rights in the invention.

TECHNICAL FIELD

Described herein are genetically engineered *Vibrio cholerae* bacteria, pharmaceutical compositions including the bacteria, and methods of using the bacteria and/or a pharmaceutical composition including the bacteria to protect against disease caused by virulent strains of *Vibrio cholerae* through a combination of rapid probiotic protection and eliciting an adaptive immune response.

SEQUENCE LISTING

The instant application contains a Sequence Listing which has been filed electronically in ASCII format and is hereby incorporated by reference in its entirety. Said ASCII copy, created on Jul. 10, 2018, is named 29618-0175WO1_SL.txt and is 5.03 megabytes in size.

BACKGROUND

Cholera is a diarrheal disease caused by an infection with the Gram-negative bacterium *Vibrio cholerae*. The disease can be a rapidly fatal, and outbreaks often spread explosively. Efforts to fight the disease include oral rehydration and antibiotic therapy. However, the disease is a major public health hazard in developing and destabilized countries (see, e.g., Bohles et al. (2014) *Hum. Vaccin. Immunother.* 10(6): 1522-35). Vaccination campaigns deploying vaccines comprising killed *Vibrio cholerae* bacterial strains are currently underway. However, the utility of these vaccines for curtailing the spread of an ongoing epidemic (so-called 'reactive vaccination') depends on the time required for vaccinated subjects to become resistant to cholera. The protective immune responses elicited by current vaccines typically take days or weeks to manifest and often require multiple vaccine doses. Thus, there is a need for vaccines that can induce rapid protection against *Vibrio cholerae* after a single dose.

SUMMARY

Described herein are attenuated *V. cholerae* bacterial strains that act, in an unprecedented manner, both as probiotic agents, to rapidly protect against cholera, and as traditional vaccines, to elicit the long-lived protective immunity to cholera observed of existing cholera vaccines. The attenuated *V. cholerae* bacterial strains described herein, as HaitiV, are derived from a recent clinical isolate, include multiple genetic modifications, and exhibit robust, multi-day occupancy of the intestine that is suggestive/predictive of their potential to engender long-lived immunity to cholera in humans. Surprisingly, a single dose of the attenuated bacterial strains is capable of conferring protection against a lethal challenge within 24 hours of HaitiV-administration in the infant rabbit model of cholera. The observation of such rapid protection in a neonatal model of infection is inconsistent with the protective immunity elicited by traditional vaccines. Instead, the ability of live HaitiV to rapidly mediate colonization resistance and disease protection against multiple challenge strains indicates that HaitiV, unlike existing vaccines, confers probiotic protection against cholera. Moreover, mathematical modeling indicates that the unprecedented speed of HaitiV-mediated protection could dramatically improve the public health impact of reactive vaccination. Thus, administration of the bacterial strains described herein can be used to reduce the risk of cholera infection, in particular during an ongoing epidemic, by engendering both rapid and long-lived protection.

Moreover, an attenuated *V. cholerae* bacterial strain may be induced to revert into a virulent strain by reacquiring virulence genes, and methods of preventing and/or mitigating the possibility of HaitiV's reversion to toxigenicity are also provided. Of particular concern are the genes encoding cholera toxin, the pathogen's principal diarrheagenic factor, which are deleted from live cholera vaccines. Any means of horizontal gene transfer, including re-infection by the cholera toxin encoding bacteriophage (CTXΦ) or natural transformation, may be sufficient to induce vaccine reversion. Applicants have developed attenuated *V. cholerae* bacterial strains modified to include RNA-guided endonuclease systems capable of specifically targeting the ctxA gene, which encodes the active subunit of cholera toxin. This strategy provides a biosafety mechanism to prevent *V. cholerae* bacteria from reacquiring ctxA, by any means, including infection with the CTXΦ prophage. Furthermore, this strategy can be generalized to other attenuated vaccine strains (e.g., Vaxchora and Peru-15) by engineering the strains to produce anti-virulence factor CRISPR systems from plasmid-encoded or chromosomally-integrated constructs.

In one aspect, the disclosure provides a genetically engineered *Vibrio cholerae* bacterium having a deletion in a nucleic acid sequence encoding a cholera toxin subunit A; a heterologous nucleic acid sequence encoding a Cas9 nuclease molecule; and a heterologous nucleic acid sequence encoding a guide RNA (gRNA), wherein the gRNA includes a targeting domain which is complementary with a target nucleic acid sequence of ctxA.

In some embodiments, a genetically engineered *V. cholerae* bacterium provided herein has a deletion in the nucleic acid sequence encoding the cholera toxin subunit A that is located in a ctxA gene that was integrated into the genome of the bacterium.

In some embodiments, a genetically engineered *V. cholerae* bacterium provided herein has a deletion in a nucleic acid sequence of the core region of a CTXΦ genome that was integrated into the genome of the bacterium.

In some embodiments, a genetically engineered *V. cholerae* bacterium provided herein has a deletion in a nucleic acid sequence of the RS2 region of a CTXΦ genome that was integrated into the genome of the bacterium.

In some embodiments, a genetically engineered *V. cholerae* bacterium provided herein has a complete deletion of a CTXΦ genome that was integrated into the genome of the bacterium.

In another aspect, the disclosure provides a genetically engineered *Vibrio cholerae* bacterium having a heterologous nucleic acid sequence encoding a Cas9 nuclease molecule; and a heterologous nucleic acid sequence encoding a guide RNA (gRNA), wherein the gRNA includes a targeting domain which is complementary with a target nucleic acid sequence of CTXΦ.

In some embodiments, target nucleic acid sequence of the CTXΦ genome is located in a gene selected from the group consisting of rstR, rstA, rstB, psh, cep, orfU, ace, zot, ctxA and ctxB. In some embodiments, the target nucleic acid sequence of the CTXΦ genome is located in a ctxA gene. In some embodiments, the gRNA comprises or consists of the nucleic acid sequence 5'-cctgatgaaataaagcagtcgttttagagctagaaatagc aagttaaaataaggctagtccgttatcaacttgaaaaagtggcaccgagtcggtgc-3' (SEQ ID NO: 3).

In some embodiments, a genetically engineered *V. cholerae* bacterium provided herein has not previously had a copy of a CTXΦ genome integrated into the bacterial genome.

In some embodiments, a genetically engineered *V. cholerae* bacterium provided herein has a deletion in a nucleic acid sequence encoding a multifunctional-autoprocessing repeats-in-toxin (MARTX) toxin. In some embodiments, the nucleic acid sequence encoding the MARTX toxin is selected from the group consisting of rtxA, rtxB, rtxC, rtxD, and rtxE.

In some embodiments, a genetically engineered *V. cholerae* bacterium provided herein has a deletion in a nucleic acid sequence encoding a DNA-binding protein HU-beta. In some embodiments, the nucleic acid sequence encoding the DNA-binding protein HU-beta is a hupB gene.

In some embodiments, a genetically engineered *V. cholerae* bacterium provided herein has a deletion in a nucleic acid encoding a flagellin. In some embodiments, the nucleic acid sequence encoding a flagellin is selected from the group consisting of flaA, flaB, flaC, flaD, and FlaE.

In some embodiments, a genetically engineered *V. cholerae* bacterium provided herein includes a heterologous nucleic acid, wherein the heterologous nucleic acid includes a gene encoding cholera toxin subunit B that is operably-linked to a promoter. In some embodiments, the gene encoding cholera toxin subunit B is a ctxB gene. In some embodiments, the promoter is an inducible promoter. In some embodiments, the promoter is a $P_{htpg}$ promoter. In some embodiments, the promoter is a constitutive promoter.

In some embodiments, a genetically engineered *V. cholerae* bacterium provided herein has a deletion in a nucleic acid sequence encoding a RecA protein. In some embodiments, the nucleic acid sequence encoding the RecA protein is a recA gene.

In another aspect, the disclosure provides a genetically engineered *Vibrio cholerae* bacterium having a deletion in one or more nucleic acid sequences encoding a MARTX toxin selected from the group consisting of rtxA, rtxB, rtxC, rtxD, rtxE and rtxH; a deletion in one or more flagellin genes selected from the group consisting of flaA, flaB, flaC, flaD, and FlaE; a deletion in a recA gene; and a heterologous nucleic acid, wherein the heterologous nucleic acid includes a ctxB gene operably linked to a promoter (e.g., a constitutive promoter or an inducible promoter). In some embodiments, the bacterium includes a complete deletion of a CTXΦ genome that was integrated into the genome of the bacterium. In some embodiments, the bacterium has not previously had a copy of a CTXΦ prophage genome integrated into the bacterial genome.

In some embodiments, a genetically engineered *V. cholerae* bacterium provided herein includes a heterologous nucleic acid sequence encoding a Cas9 nuclease molecule; and a heterologous nucleic acid sequence encoding a guide RNA (gRNA), wherein the gRNA includes a targeting domain which is complementary with a target nucleic acid sequence of ctxA. In some embodiments, the target nucleic acid sequence of CTXΦ is located in a ctxA gene. In some embodiments, the gRNA comprises or consists of the nucleic acid sequence 5'-cctgatgaaataaagcagtcgttttagagctagaaatagcaagttaaaataaggct agtccgttatcaacttgaaaaagtggcaccgagtcggtgc-3' (SEQ ID NO: 3).

In some embodiments, a genetically engineered *V. cholerae* bacterium provided herein has a deletion in one or more of: a nucleic acid sequence encoding a product that confers resistance to trimethoprim, a nucleic acid sequence encoding a product that confers resistance to sulfamethoxazole, a nucleic acid sequence encoding a product that confers resistance to streptomycin, and a nucleic acid sequence encoding a product that confers resistance to chloramphenicol. In some embodiments, the gene encoding a product that confers resistance to trimethoprim is dfrA. In some embodiments, the gene encoding a product that confers resistance to sulfamethoxazole is sul2. In some embodiments, the gene encoding a product that confers resistance to streptomycin is strAB. In some embodiments, the gene encoding a product that confers resistance to chloramphenicol is floR.

In some embodiments, a genetically engineered *V. cholerae* bacterium provided herein is derived from a parental strain belonging to the El Tor biotype.

In some embodiments, a genetically engineered *V. cholerae* bacterium provided herein is derived from a Haiti parental strain.

In some embodiments, a genetically engineered *V. cholerae* bacterium provided herein includes a first bacterial chromosome including or consisting of the nucleic acid sequence of SEQ ID NO: 7. In some embodiments, a genetically engineered *V. cholerae* bacterium provided herein includes a second bacterial chromosome including or consisting of the nucleic acid sequence of SEQ ID NO: 51.

In one aspect, the disclosure provides a genetically engineered *Vibrio cholerae* bacterium, wherein the bacterium has mutations in the same genes, relative to its parental strain (e.g., a virulent parental strain), as the strain having ATCC deposit number PTA-125138.

In another aspect, the disclosure provides a genetically engineered *Vibrio cholerae* bacterium, wherein the bacterium is a *V. cholerae* strain having ATCC deposit number PTA-125138.

The disclosure also provides pharmaceutical compositions including a genetically engineered *Vibrio cholerae* bacterium provided herein and a pharmaceutically acceptable excipient.

The disclosure further provides methods of inducing a protective response in a subject against a virulent strain of *Vibrio cholerae*, including administering to the subject a genetically engineered *Vibrio cholerae* bacterium provided herein, or a pharmaceutical composition including the bacterium, thereby inducing the protective response against the virulent strain of *Vibrio cholerae* in the subject (e.g., a human subject). In some embodiments, the protective response is induced within 24 hours of administering the genetically engineered *Vibrio cholerae* bacterium or of the pharmaceutical composition to the subject.

Figure 5C:
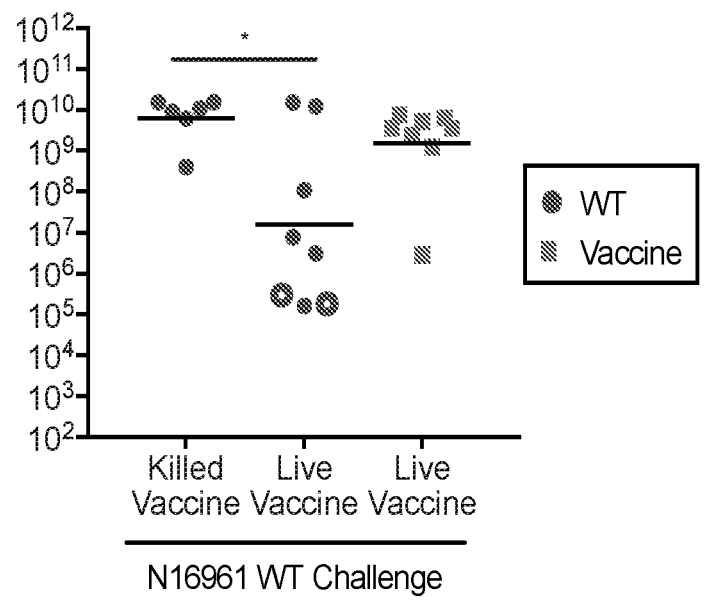
Figure 5D:
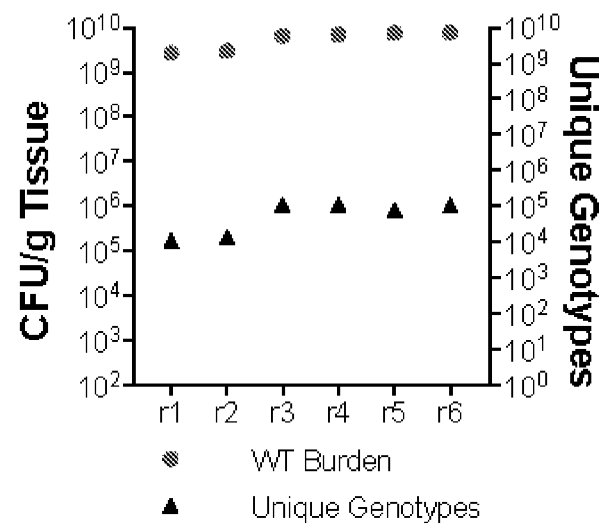
Figure 5E:
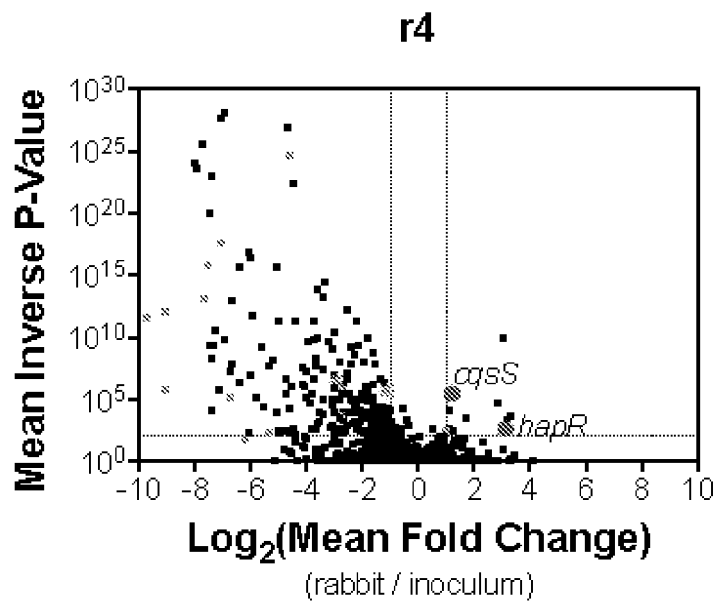
Figure 5F:
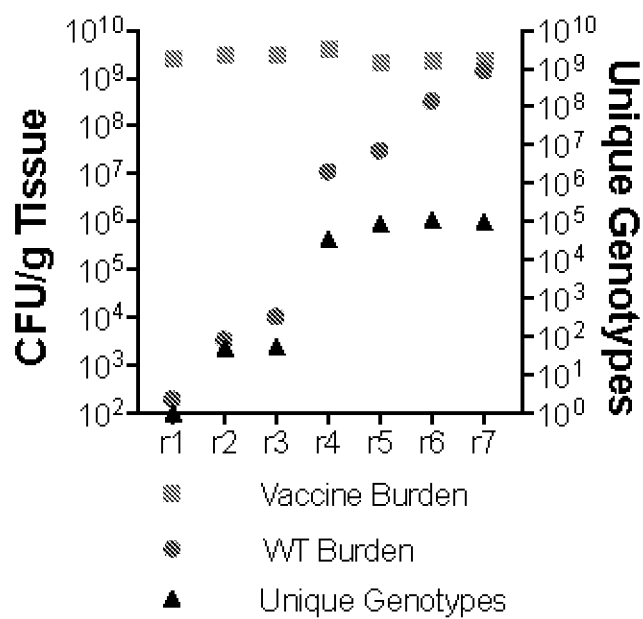
Figure 5G:
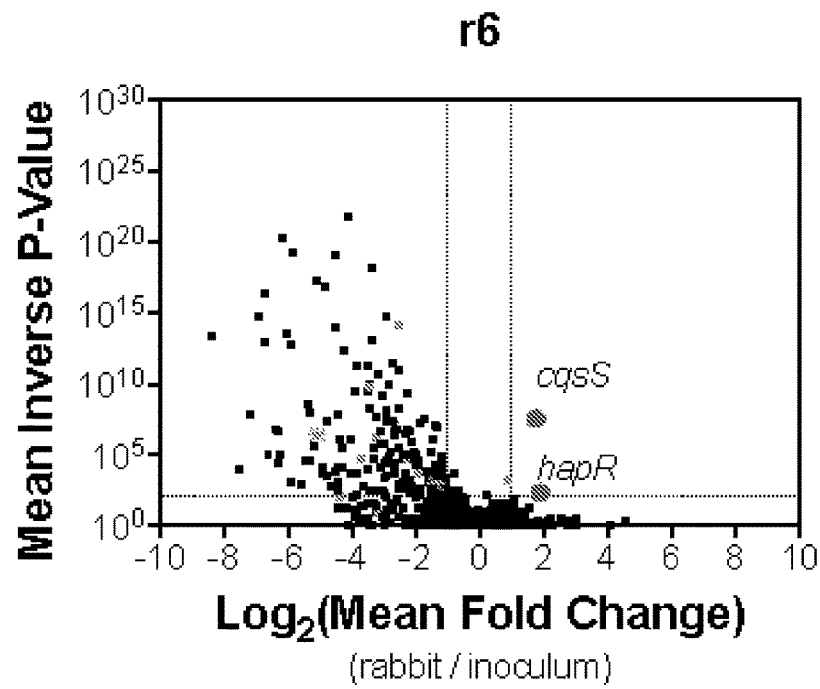

The disclosure also provides a genetically engineered *Vibrio cholerae* bacterium provided herein, for use in a method of inducing a protective response in a subject against a virulent strain of *Vibrio cholera*.

Also provided is a genetically engineered *Vibrio cholerae* bacterium provided herein, for use in a method of treating a subject who has a virulent strain of *Vibrio cholerae*.

In another aspect, the disclosure also provides a genetically engineered bacterium having a deletion of at least one virulence gene; a heterologous nucleic acid encoding a Cas9 nuclease molecule; and one or more heterologous nucleic acids encoding guide RNAs (gRNAs), wherein the gRNAs include a targeting domain that is complementary with a target nucleic acid sequence of the deleted virulence gene; wherein the Cas9 nuclease molecule is capable of binding to the gRNAs thereby forming a complex, and wherein the complex is capable of targeting and cleaving a nucleic acid sequence of the deleted virulence gene. In some embodiments, the bacterium is of a species selected from the group consisting of *Vibrio cholerae, Salmonella enterica, Shigella flexneri, Shigella sonnei, Shigella dysenteriae, Bordetella pertussis*, and *Clostridioides difficile*. In some embodiments, the virulence gene is selected from the group consisting of ctxA, aroA, aroQ, aroC, aroD, htrA, ssaV, cya, crp, phoP, phoQ, guaB, guaA, clpX, clpP, set, sen, virG/icsA, luc, aroA, msbB2, stxA, stxB, ampG, dnt, tcdA, and tcdB.

The disclosure also provides a pharmaceutical composition including a genetically engineered bacterium provided herein and a pharmaceutically acceptable excipient.

Also provided are methods of inducing a protective response in a subject against a virulent strain of bacterium described herein (e.g., *Vibrio cholerae, Salmonella enterica, Shigella flexneri, Shigella sonnei, Shigella dysenteriae, Bordetella pertussis*, and *Clostridioides difficile*), including administering to the subject a genetically engineered bacterium provided herein, or a pharmaceutical composition including the genetically engineered bacterium, thereby inducing the protective response against the virulent strain of bacterium in the subject (e.g., a human subject).

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

DESCRIPTION OF DRAWINGS

FIG. 1 depicts the deletion of the CTXΦ prophage and adjacent sequences, including the satellite prophages, TLC and RS1, and MARTX toxin genes (shadowed area is the deleted region).

FIG. 2 depicts the deletions in genes conferring resistance to trimethoprim (dfrA), sulfamethoxazole (sul2) streptomycin (strAB) and chloramphenicol (floR).

FIGS. 3A, 3B and 3C depict an anti-ctxA CRISPR system which provides immunity to CTXΦ infection. FIG. 3A depicts a *Streptococcus pyogenes* Cas9 along with sequence encoding a guide RNA targeting ctxA, integrated into the HaitiV lacZ locus. FIG. 3B is a schematic showing targeting of the CTXΦ genome by the anti-ctxA Cas9-sgRNA complex. FIG. 3C is a bar graph showing the transduction efficiency in HaitiV with/without the CRISPR system (CRISPR+/−) that were infected with either CTXΦ-IGKn (Target+; intergenic $Kan^R$ cassette, intact ctxA) or CTX-KnΦ (Target-; ctxA replaced by $Kan^R$ cassette), and the number of transductants was monitored. No detectable $Kan^R$ transductants shown as "*".

FIGS. 4A, 4B, 4C, 4D, and 4E show that HaitiV colonizes the infant rabbit intestine without causing cholera-like illness. FIG. 4A is a bar graph depicting the fluid accumulation ratios after littermates were inoculated with either wild type ("WT"; n=11) or HaitiV ("Vaccine"; n=10). Plots show mean and standard deviation derived from 2 litters. **$P<0.001$, unpaired t-test. FIG. 4B is a line graph showing the successive daily body weights of animals inoculated with approximately $10^9$ CFU HaitiV (n=10). FIG. 4C is a dot plot showing the WT CFU (circles) or HaitiV CFU (squares) recovered from rabbit distal small intestines (dSI) at Day 1 or 4 post-inoculation (2 litters/group). Lines indicate geometric means. Hollow points indicate limit of detection when no CFU were recovered. NS: $P>0.05$, Kruskall-Wallis test followed by Dunn's multiple comparisons test. FIG. 4D depicts the competitive indices (CI) of dSI bacteria 1 day post-inoculation with a 1:1 mixture of WT and HaitiV. Hollow points show the limit of detection when no vaccine CFU were recovered; lines and bars indicate geometric means and geometric standard deviation of CIs across 2 litters, (n=6). FIG. 4**E is a dot plot showing the WT CFU (circles) and HaitiV CFU (squares) recovered from co-inoculated animals; lines indicate geometric means.

FIGS. 5A, 5B, 5C, 5D, 5E, 5F, and 5G show that HaitiV mediates colonization resistance associated with variably-sized infection bottlenecks. FIG. 5A shows WT CFU (circles) recovered from dSI of animals 18 hours after inoculation with WT. Littermates were pretreated with sodium bicarbonate buffer (mock, n=8) or formalin-killed HaitiV (killed vaccine, n=7) 24 hours prior to WT challenge; geometric means of each group across 3 litters are shown. NS: $P>0.05$, Mann-Whitney test. FIG. 5B shows WT CFU (circles) or HaitiV CFU (squares) recovered from the dSI of animals 18 hours post-challenge with WT. Animals were pretreated with killed (n=6) or live (n=8) vaccine 24 hours prior to challenge. Hollow points indicate limit of detection when no CFU were recovered, and lines indicate the geometric mean of each group across 2 litters. *$P<0.001$, Mann-Whitney test. FIG. 5**C shows WT CFU (circles) or HaitiV CFU (squares) recovered from the dSI of animals 18 hours post-challenge with WT, of the N16961 strain. Animals were pretreated with killed (n=6) or live (n=8) vaccine 24 hours prior to challenge. Hollow points indicate limit of detection when no CFU were recovered, and lines indicate the geometric mean of each group across 2 litters. *$P<0.05$, Mann-Whitney test. FIG. 5D depicts the WT CFU (circles), and unique transposon mutants (triangles) recovered from the dSI of individual animals (rabbits r1 to r6) one day after inoculation of the transposon mutant library without pretreatment. FIG. 5F depicts the WT CFU (circles), HaitiV CFU (squares), and unique transposon mutants (triangles) recovered from the dSI of individual animals (rabbits r1 to r7) one day after inoculation of the transposon mutant library. Animals were pretreated with HaitiV 24 hours prior to challenge with the transposon mutant library. FIGS. 5E and 5G depict the results of Con-ARTIST (see Pritchard et al. (2014) *PLoS Genet.* 10: e1004782) analysis for single inoculation (rabbit r4; FIG. 5E) and sequential inoculation (rabbit r6; FIG. 5G) samples with the largest number of unique genotypes. The x-axis indicates the change in relative abundance of insertion mutants per gene in vivo, and the y-axis indicates the concordance of independent insertion mutants within each gene. Genes exhibiting a greater than 2-fold change ($Log_2$(mean fold change)<−1 or >1) across multiple mutants (mean inverse P-value>$10^2$) are considered depleted/enriched. Enriched mutants cqsS and hapR are indicated. Mutations in critical colonization factors, including toxin co-regulated pilus biogenesis (circles), and the associated transcriptional regulators toxR and toxS (asterisks), were depleted.

Figure 6A:
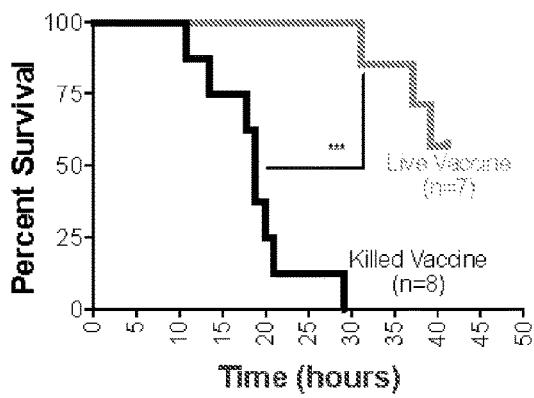
Figure 6B:
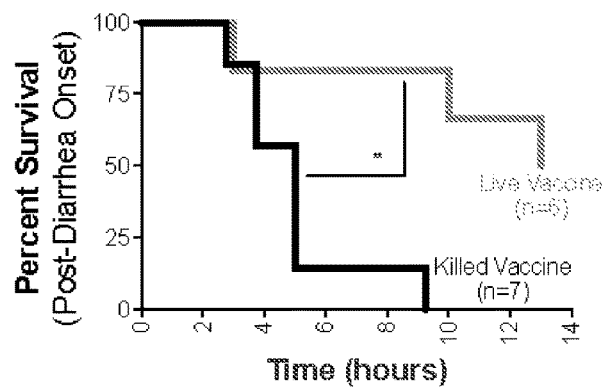
Figure 6C:
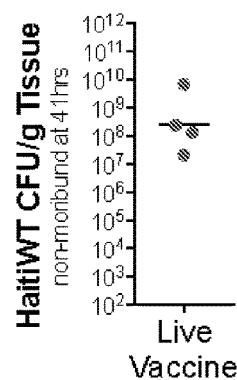
Figure 6D:
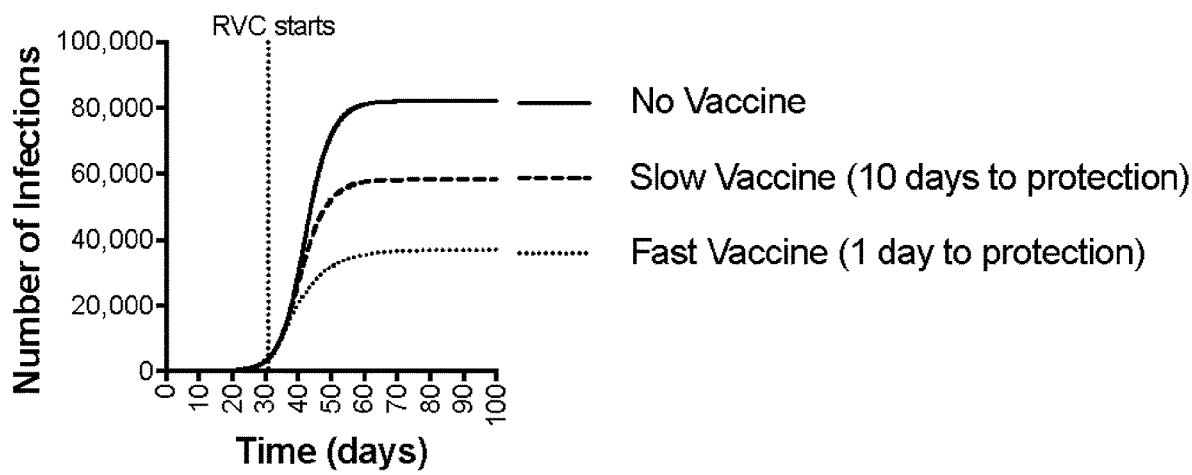

FIGS. 6A, 6B, 6C and 6D show that HaitiV colonization protects from disease following HaitiWT challenge, and modeling demonstrates the benefit of rapid protection during a cholera outbreak. FIG. 6A depicts survival curves tracking progression to moribund disease status in animals inoculated with WT at 0 hours after pretreatment (at t=−24 hours) with killed (black) or live vaccine (red). *P<0.001, Log-rank test. FIG. 6B depicts the disease progression from the onset of diarrhea to moribund status in animals (from FIG. 6A) that developed visible diarrhea. *P<0.001, Log-rank test. FIG. 6C depicts WT CFU (circles) recovered from dSI of animals (from FIG. 6A) that did not progress to moribund disease status. FIG. 6D depicts the effect of reactive vaccination on the number of cholera infections in a simulated outbreak ($R_0$=2.1) starting with a single infection in a population of 100,000 susceptible individuals where the reactive vaccination campaign (RVC) is triggered once the number of symptomatic individuals reaches 1000 (1% of the total population), indicated by the dashed line. The rollout of doses is modeled with a constant rate over 7 days until 70% of the population is vaccinated, as achieved by recent reactive vaccination campaigns. Modeling parameters are described in FIG. 10B FIG. 7 is a Western blot showing that HaitiV produces only the B subunit of cholera toxin. Cell-free supernatant from Haiti wild type ("Haiti WT") and HaitiV, as well as purified cholera toxin ("Purified CT"), was separated by polyacrylamide gel electrophoresis. Immunoblotting with polyclonal anti-CTX antibody revealed the presence of CT-B, but not CT-A, in the supernatant of HaitiV.

FIGS. 8A, 8B, 8C, and 8D show the results of Con-ARTIST analyses for single inoculation samples. The x-axes indicate the change in relative abundance of insertion mutants per gene in vivo, and the y-axes indicate the concordance of independent insertion mutants within each gene. Genes exhibiting a greater than 2-fold change (Log 2(mean fold change)<−1 or >1) across multiple mutants (mean inverse P-value>100) are considered depleted/enriched. cqsS and hapR are indicated. A subset of colonization factors, including toxin co-regulated pilus biogenesis components (circles) and the associated transcriptional regulators toxR and toxS (asterisks), are indicated also.

FIGS. 9A, 9B, 9C, and 9D show the results of Con-ARTIST analyses for sequential inoculation samples. The x-axes indicate the change in relative abundance of insertion mutants per gene in vivo, and the y-axes indicate the concordance of independent insertion mutants within each gene. Genes exhibiting a greater than 2-fold change (Log 2(mean fold change)<−1 or >1) across multiple mutants (mean inverse P-value>102) are considered depleted/enriched. cqsS and hapR are indicated. A subset of colonization factors, including toxin co-regulated pilus biogenesis components (circles) and the associated transcriptional regulators toxR and toxS (asterisks), are indicated also.

FIG. 10A depicts an overview of the SEIR cholera transmission model with delayed vaccine effect. Circles indicate the subpopulations of the model (Susceptible, Exposed, Infectious, Recovered, with subscripts U: unvaccinated, V: vaccinated, but not yet protected, and P: Protected), while arrows indicate transitions between sub-populations. FIG. 10B is a list of parameters used in modeling.

FIGS. 11A and 11B show the impact of transmission potential ($R_0$) and either rollout rate (FIG. 11A) or triggering threshold (FIG. 11B) of the vaccination campaign on the relative protection (fractional reduction in cases) of a fast-acting vaccine over a slow-acting vaccine.

FIGS. 12A, 12B, 12C, and 12D are graphs depicting the vibriocidal activity of sera from mice inoculated with HaitiV or CVD103-HgR*. FIG. 12A is a graph depicting the vibriocidal response of sera from C57BL/6 mice inoculated with HaitiV against a serotype Inaba *V. cholerae* strain. FIG. 12B is a graph depicting the vibriocidal response of sera from Swiss-Webster mice inoculated with either HaitiV (black circles) or CVD103-HgR* (empty squares and dashed lines) against a serotype Inaba *V. cholerae* strain. FIG. 12C is a graph depicting the vibriocidal response of sera from C57BL/6 mice inoculated with HaitiV against a serotype Ogawa *V. cholerae* strain. FIG. 12D is a graph depicting the vibriocidal response of sera from Swiss-Webster mice inoculated with either HaitiV (black circles) or CVD103-HgR* (empty squares and dashed lines) against a serotype Ogawa *V. cholerae* strain. Bold black dashes above the x-axis indicate time points at which animals were orogastrically inoculated with HaitiV or CVD103-HgR*. The dashed line along the y-axis indicates the assay limit of detection.

FIGS. 13A, 13B, 13C, and 13D are graphs depicting the IgA and IgG response against O-antigen-specific polysaccharide (OSP) from a serotype Ogawa *V. cholerae* strain over time in mice inoculated with HaitiV or CVD103-HgR*. FIG. 13A is a graph depicting the anti-OSP IgA response in C57BL/6 mice inoculated with HaitiV against OSP from a serotype Ogawa *V. cholerae* strain. FIG. 13B is a graph depicting the anti-OSP IgA response in Swiss-Webster mice inoculated with either HaitiV (black circles) or CVD103-HgR* (empty squares and dashed lines) against OSP from a serotype Ogawa *V. cholerae* strain. FIG. 13C is a graph depicting the anti-OSP IgG response in C57BL/6 mice inoculated with HaitiV against OSP from a serotype Ogawa *V. cholerae* strain. FIG. 13D is a graph depicting the anti-OSP IgG response in Swiss-Webster mice inoculated with either HaitiV (black circles) or CVD103-HgR* (empty squares and dashed lines) against OSP from a serotype Ogawa *V. cholerae* strain. Bold black dashes above the x-axis indicate time points at which animals were orogastrically inoculated with HaitiV or CVD103-HgR*.

FIGS. 14A, 14B, 14C, and 14D are graphs depicting the IgA and IgG response against O-antigen-specific polysaccharide (OSP) from a serotype Inaba *V. cholerae* strain over time in mice inoculated with HaitiV or CVD103-HgR*. FIG. 14A is a graph depicting the anti-OSP IgA response in C57BL/6 mice inoculated with HaitiV against OSP from a serotype Inaba *V. cholerae* strain. FIG. 14B is a graph depicting the anti-OSP IgA response in Swiss-Webster mice inoculated with either HaitiV (black circles) or CVD103-HgR* (empty squares and dashed lines) against OSP from a serotype Inaba *V. cholerae* strain. FIG. 14C is a graph depicting the anti-OSP IgG response in C57BL/6 mice inoculated with HaitiV against OSP from a serotype Inaba *V. cholerae* strain. FIG. 14D is a graph depicting the anti-OSP IgG response in Swiss-Webster mice inoculated with either HaitiV (black circles) or CVD103-HgR* (empty squares and dashed lines) against OSP from a serotype Inaba *V. cholerae* strain. Bold black dashes above the x-axis indicate time points at which animals were orogastrically inoculated with HaitiV or CVD103-HgR*.

DETAILED DESCRIPTION

Genetically Engineered Bacteria

Provided herein is a genetically engineered *Vibrio cholerae* bacterium that may be used to induce protection from virulent *V. cholerae* within 24 hours of its administration to a subject. Vaccination with live attenuated *V. cholerae* bacterial strains is a promising strategy for inducing a protective immune response against the bacterium. The genes (ctxA and ctxB) encoding the main virulence factor in *V. cholerae*, cholera toxin (CT), are deleted from many live attenuated *V. cholerae* vaccine candidates but carried by CTXΦ, a filamentous bacteriophage that infects *V. cholerae*, integrating its genome into the *V. cholerae* chromosome and/or replicating extra-chromosomally as a plasmid. Thus, there is a significant risk that CTXΦ infection of an attenuated strain of *V. cholerae* may induce the strain to revert to a virulent state; other means of gene acquisition, including natural transformation, can also mediate reversion. Methods of preventing and/or mitigating the possibility of acquisition of cholera toxin, e.g., by CTXΦ infection or transformation by attenuated *V. cholerae* bacterial strains are highly desirable to ensure the biosafety of vaccines including the attenuated *V. cholerae* strains.

In some embodiments, the bacterium is attenuated (i.e., has reduced virulence as compared to a parental strain from which it was derived). The bacterium may include one or more of the genetic modifications described herein in order to achieve attenuated state. The genetic modifications include, but are not limited to, a complete or partial deletion of a gene, and genetic modifications that alter the ability of the bacteria to express the gene (e.g., alterations to a promoter element that render it inoperable).

In some embodiments, the bacterium is of the genus *Vibrio*. In some embodiments, the bacterium is of the species *Vibrio cholerae*. Any *V. cholerae* strain, including clinical isolates, can be used as described herein. In some embodiments, the *V. cholerae* bacterium belongs to the O1 serogroup. In some embodiments, the *V. cholerae* bacterium belongs to the O1 serogroup and is of the classical biotype. In some embodiments, the *V. cholerae* bacterium belongs to the O1 serogroup and is of the El Tor biotype. In some embodiments, the *V. cholerae* bacterium belongs to the O1 serogroup and is of the variant El Tor biotype. In some embodiments, the *V. cholerae* bacterium belongs to the O139 serogroup. In some embodiments, the *V. cholerae* bacterium belongs to the Inaba serotype. In some embodiments, the *V. cholerae* bacterium belongs to the Ogawa serotype. In some embodiments, the *V. cholerae* bacterium belongs to the Hikojima serotype. In some embodiments, the *V. cholerae* bacterium is derived from a Haitian clinical isolate. In some embodiments, the *V. cholerae* bacterium is derived from a strain selected from the group consisting of O395, N16961, B33, D34122, D34642, and D34755. In some embodiments, the *V. cholerae* bacterium is derived from an H1 strain (also known as KW3 strain (see NCBI Ref. Seq. GCF_000275645.1 and Ref. Seq. GCF_001318185.1)). Virulent *V. cholerae* strains encode two major virulence factors: cholera toxin (CT) and the toxin co-regulated pilus (TCP) that are encoded by the lysogenic bacteriophage CTXΦ and a chromosomal pathogenicity island, respectively. The bacteriophage CTXΦ can convert a non-pathogenic strain of *V. cholerae* into a pathogenic strain through phage infection, a process by which the phage genome integrates into the host genome or is maintained as a plasmid, both of which provide the host bacterium with virulence genes.

The CTXΦ genome is approximately 6.9 kb in size and is organized into two functionally distinct regions (see e.g., McLeod et al. (2005) *Mol. Microbiol.* 57(2): 347-56; and Kim et al. (2014) *J. Microbiol. Biotechnol.* 24(6): 725-31). The first region, repeat sequence 2 (RS2) includes three genes: rstR, rstA and rstB. rstA and rstB encode the proteins RstA and RstB, respectively, which are required for CTX DNA replication and integration into the bacterial chromosome. rstR encodes the repressor protein RstR. The second region, referred to as the core region, includes the genes psh, cep, orfU (gIII), ace, zot, and ctxAB. The psh, cep, orfU, ace, and zot genes encode the proteins Psh, Cep, OrfU (pIII$^{CTX}$), Ace, and Zot, respectively, which are required for phage packaging and secretion. The ctxAB is an operon includes the ctxA and ctxB genes which encode the protein subunits of cholera toxin, CtxA and CtxB, respectively. Together, ctxA and ctxB encode the Cholera toxin (CT) virulence factor that consists of one CT-A subunit and five CT-B subunits.

In some embodiments, the *V. cholerae* bacterium described herein includes one or more genetic alterations in order to reduce, inhibit and/or alter the expression of one or more CTXΦ genome genes that are integrated in the bacterial genome in order to reduce the virulence of the bacterium. The genetic alterations include, but are not limited to a deletion, mutation, insertion in the open reading frame of a CTXΦ genome gene to alter the expression and function of the gene product, or in a promoter or transcriptional regulatory element in order to inhibit the expression of the gene. In some embodiments, the *V. cholerae* bacterium includes a deletion of all copies of the integrated CTXΦ genome and the adjacent (and related) RS1 element, a satellite phage that can be packaged by CTXΦ. In some embodiments, the *V. cholerae* bacterium includes a deletion in a nucleic acid sequence of an integrated CTXΦ genome gene. In some embodiments, the *V. cholerae* bacterium has been genetically modified to completely delete a nucleic acid sequence including or consisting of a CTXΦ genome that was incorporated into the bacterial chromosome. In some embodiments, the *V. cholerae* bacterium has been genetically modified to partially delete a nucleic acid sequence including a CTXΦ genome that was incorporated into the bacterial chromosome. In some embodiments, the *V. cholerae* bacterium has been genetically modified to delete a nucleic acid sequence including or consisting of the RS2 region of a CTXΦ genome that was incorporated into the bacterial chromosome. In some embodiments, the *V. cholerae* bacterium has been genetically modified to delete a nucleic acid sequence including or consisting of the core region of a CTXΦ genome that was incorporated into the bacterial chromosome. In some embodiments, the *V. cholerae* bacterium has been genetically modified to delete a nucleic acid sequence including or consisting of a gene selected from the group consisting of rstR, rstA, rstB, psh, cep, orfU (gIII), ace, zot, ctxA and ctxB. In some embodiments, the *V. cholerae* bacterium has been genetically modified to delete a nucleic acid sequence including or consisting of a ctxA gene. In some embodiments, the *V. cholerae* bacterium has been genetically modified to delete a nucleic acid sequence including or consisting of a ctxB gene. In some embodiments, the *V. cholerae* bacterium has been genetically modified to delete a nucleic acid sequence including or consisting of a ctxAB operon. In some embodiments, the *V. cholerae* bacterium has been genetically modified to delete an attB (attachment) site where CTXΦ phage integrates.

In some embodiments, the *V. cholerae* bacterium includes one or more genetic alterations in order to reduce, inhibit and/or alter the expression of one or more RS1 satellite phage genes and/or one or more TCL satellite phage genes that are integrated in the bacterial genome. Integrated copies of the CTXΦ prophage genome are often flanked by copies of the RS1 satellite phage and the TLC satellite phage. The TLC satellite phage is involved in altering the *V. cholerae* genome to enhance the integration of the CTXΦ and RS1 phages, while the RS1 phage uses some of the CTXΦ-encoded proteins for packaging and secretion (see, e.g., Samruzzaman et al. (2014) *Infect. Immun.* 82(9): 3636-43. In some embodiments, the *V. cholerae* bacterium includes a partial deletion of an integrated copy of the RS1 phage genome. In some embodiments, the *V. cholerae* bacterium includes a complete deletion of an integrated copy of the RS1 phage genome. In some embodiments, the *V. cholerae* bacterium includes a partial deletion of an integrated copy of an RS1 phage gene. In some embodiments, the *V. cholerae* bacterium includes a complete deletion of an integrated copy of an RS1 phage gene. In some embodiments, the *V. cholerae* bacterium includes a partial deletion of an integrated copy of the TLC phage genome. In some embodiments, the *V. cholerae* bacterium includes a complete deletion of an integrated copy of the TLC phage genome. In some embodiments, the *V. cholerae* bacterium includes a partial deletion of an integrated copy of an TLC phage gene. In some embodiments, the *V. cholerae* bacterium includes a complete deletion of an integrated copy of an TLC phage gene.

In some embodiments, the *V. cholerae* bacterium includes a genetic modification that renders the bacterium incapable of facilitating the replication of CTXΦ. For example, the DNA binding protein HUβ promotes replication of the plasmid form of CTXΦ in *V. cholerae* (see, Martinez et al. (2015) *PLoS Genetics* 11(5): e1005256, the entire contents of which are expressly incorporated herein by reference). In *V. cholerae*, HUβ is encoded by hupB (also known as VC1919). Thus, in some embodiments, the *V. cholerae* bacterium includes a genetic alteration that alters the function and/or expression of hupB. In some embodiments, the *V. cholerae* bacterium includes a partial deletion of the hupB gene. In some embodiments, the *V. cholerae* bacterium includes a complete deletion of the hupB gene.

In some embodiments, the *V. cholerae* bacterium includes a genetic modification that renders the bacterium incapable of producing and/or secreting a multifunctional-autoprocessing repeats-in-toxin (MARTX) toxin. The MARTX toxin rtx gene loci in *V. cholerae* consists of two divergently transcribed operons rtxHCA and rtxBDE. In *V. cholerae*, the MARTX toxin, RtxA, is encoded by the gene rtxA, and facilitates bacterial colonization of the intestine (see, e.g., Satchell et al. (2015) *Microbiol. Spectr.* 3(3) and Fullner et al. (2002) *J. Exp. Med.* 195(11): 1455-62; and Olivier et al. (2009) *PLoS One* 4(10): e7352, the entire contents of each of which are incorporated herein by reference). Adjacent gene rtxC encodes the putative acytltransferase rtxC, while rtxH encodes a hypothetical protein with uncharacterized function (see Gavin and Satchell (2015) *Pathog. Dis.* 73(9): ftv092, the entire contents of which are incorporated herein by reference). The genes of the rtxBDE operon encode a dedicated MARTX toxin Type 1 secretion system (T1SS), whereby rtxB and rtxE encode the ATPase proteins RtxB and RtxE, respectively, and rtxD encodes the transmembrane protein RtxD which acts in concert with the outer membrane porin TolC to secrete RtxA from the bacterial cytoplasm to the extracellular environment (see Gavin and Satchell (2015)). In some embodiments, the *V. cholerae* bacterium includes a genetic alteration that alters the function of the MARTX toxin. In some embodiments, the *V. cholerae* bacterium includes a partial deletion of the rtxA gene. In some embodiments, the *V. cholerae* bacterium includes a complete deletion of the rtxA gene. In some embodiments, the *V. cholerae* bacterium includes a partial deletion of the rtxB gene. In some embodiments, the *V. cholerae* bacterium includes a complete deletion of the rtxB gene. In some embodiments, the *V. cholerae* bacterium includes a partial deletion of the rtxC gene. In some embodiments, the *V. cholerae* bacterium includes a complete deletion of the rtxC gene. In some embodiments, the *V. cholerae* bacterium includes a partial deletion of the rtxD gene. In some embodiments, the *V. cholerae* bacterium includes a complete deletion of the rtxD gene. In some embodiments, the *V. cholerae* bacterium includes a partial deletion of the rtxE gene. In some embodiments, the *V. cholerae* bacterium includes a complete deletion of the rtxE gene. In some embodiments, the *V. cholerae* bacterium includes a partial deletion of the rtxH gene. In some embodiments, the *V. cholerae* bacterium includes a complete deletion of the rtxH gene. In some embodiments, the *V. cholerae* bacterium includes a partial deletion of the rtxHCA operon. In some embodiments, the *V. cholerae* bacterium includes a complete deletion of the rtxHCA operon. In some embodiments, the *V. cholerae* bacterium includes a partial deletion of the rtxBDE operon. In some embodiments, the *V. cholerae* bacterium includes a complete deletion of the rtxBDE operon.

In some embodiments, the *V. cholerae* bacterium includes a genetic modification to reduce the reactogenicity of the bacterium after administration to a subject (e.g., a human subject). Some attenuated oral *V. cholerae* vaccine strains have induced reactogenicity symptoms that included non-choleric diarrhea and abdominal cramps; however, *V. cholerae* strains lacking flagellin-encoding genes have been demonstrated to exhibit reduced reactogenicity in animal models (see, e.g., Rui et al. (2010) *Proc. Nat'l. Acad. Sci. USA* 107(9): 4359-64, the entire contents of which are expressly incorporated herein by reference.) *V. cholerae* includes two operons, flaAC and flaDBE, which include five flagellin-encoding genes. In some embodiments, the *V. cholerae* bacterium includes a genetic alteration that alters the function of at least one gene encoding a flagellin. In some embodiments, the *V. cholerae* bacterium includes a partial deletion in a gene encoding a flagellin. In some embodiments, the *V. cholerae* bacterium includes a complete deletion in a gene encoding a flagellin. In some embodiments, the *V. cholerae* bacterium includes a complete or partial deletion in a flagellin gene selected from the group consisting of flaA, flaB, flaC, flaD, and flaE. In some embodiments, the *V. cholerae* bacterium includes a complete or partial deletion of the flaAC operon. In some embodiments, the *V. cholerae* bacterium includes a complete or partial deletion of the flaBDE operon. In some embodiments, the *V. cholerae* bacterium includes a complete or partial deletion of both the flaAC operon and the flaBDE operon.

In some embodiments, the *V. cholerae* bacterium includes a deletion in an antibiotic resistance gene to prevent the dispersal of the antibiotic resistance genes to other bacteria. In some embodiments, the *V. cholerae* bacterium includes a partial deletion in an antibiotic resistance gene. In some embodiments, the *V. cholerae* bacterium includes a complete deletion in an antibiotic resistance gene. In some embodiments, the antibiotic resistance gene is selected from the group consisting of floR (which confers resistance to chloramphenicol), strAB (which confers resistance to streptomycin), sul2 (which confers resistance to sulfisoxazole and sulfamethoxazole), and dfrA (which confers resistance to trimethoprim). In some embodiments, the *V. cholerae* bacterium includes a complete deletion of each of the following antibiotic resistance genes: floR, strAB, dfrA, and sul2.

In some embodiments, the *V. cholerae* bacterium includes a genetic modification that renders the bacterium incapable of producing RecA. The gene recA encodes the multifunctional protein RecA, which is involved in homologous recombination, DNA repair, and the SOS response (see, e.g., Thompson et al. (2004) *Int. J. Syst. Evol. Microbiol.* 54 (Pt. 3): 919-24, the entire contents of which are expressly incorporated herein by reference). In some embodiments, the *V. cholerae* bacterium includes a deletion in the recA gene. In some embodiments, the deletion is a partial deletion. In some embodiments, the deletion is a complete deletion. Without wishing to be bound by any particular theory, deletion of recA prevents homologous recombination-dependent gene acquisition by the *V. cholerae* bacterium and its ability to resolve mutations that arise from environmental exposure such as UV light.

In some embodiments, the *V. cholerae* bacterium includes a heterologous nucleic acid or a heterologous gene. The term "heterologous nucleic acid" or "heterologous gene" refers to a nucleic acid that is not normally found in a given cell in nature (e.g., a nucleic acid that is exogenously introduced into a given cell; or a nucleic acid that has been introduced into the host cell in a form that is different from the corresponding native nucleic acid). It will be readily understood by those of skill in the art that a heterologous nucleic acid may comprise a gene that is codon-optimized for use in a *V. cholerae* bacterium described herein.

In some embodiments, the *V. cholerae* bacterium includes a heterologous nucleic acid encoding an antigenic polypeptide. In some embodiments, the expression of the nucleic acid encoding the antigenic polypeptide is operably-linked to a constitutive promoter. In some embodiments, the nucleic acid encoding the antigenic polypeptide is operably-linked to an inducible promoter. In some embodiments, the heterologous nucleic acid encoding an antigenic polypeptide is integrated in the bacterial genome. In some embodiments, the heterologous nucleic acid encoding an antigenic polypeptide is present on a plasmid. In some embodiments, the antigenic polypeptide is the cholera toxin subunit CtxB. Expression of the cholera toxin CtxB subunit by the *V. cholerae* bacterium described herein may be particularly advantageous as it may promote the induction of an anti-CtxB immune response in a subject to whom the bacterium is administered, thereby resulting in immunoprotection against *V. cholerae* and enterotoxigenic *E. coli* (ETEC) (see, e.g., Kauffman et al. (2016) *mBio* 7(6): e02021-16, the entire contents of which are expressly incorporated herein by reference). Thus, in some embodiments, the *V. cholerae* bacterium includes a heterologous nucleic acid comprising the *V. cholerae* ctxB gene. In some embodiments, the *V. cholerae* bacterium includes a heterologous nucleic acid comprising the *V. cholerae* ctxB gene is operably linked to an inducible promoter (e.g., a $P_{htpg}$ promoter). In some embodiments, the *V. cholerae* bacterium includes a heterologous nucleic acid comprising the *V. cholerae* ctxB gene is operably linked to an inducible promoter. In some embodiments, the heterologous nucleic acid comprising the *V. cholerae* ctxB gene is present on the bacterial chromosome. In some embodiments, the *V. cholerae* bacterium includes the mutation N900_11550::Phtpg-ctxB. In some embodiments, the *V. cholerae* bacterium includes a heterologous nucleic acid encoding CtxB integrated into the chromosome at a locus homologous to the N900_11550 locus of HaitiWT (Bioproject Accession No. PRJNA215281; Biosample Accession No. SAMN04191514). In some embodiments, the *V. cholerae* bacterium includes a heterologous nucleic acid encoding CtxB integrated into the chromosome at a locus homologous to the N900_RS07040 locus of HaitiWT. In some embodiments, the *V. cholerae* bacterium includes a heterologous nucleic acid encoding CtxB integrated into the chromosome at a locus homologous to the N900_RS07045 locus of HaitiWT.

In some embodiments, the *V. cholerae* bacterium includes a bacterial chromosome, wherein the bacterial chromosome includes or consists of the nucleic acid sequence of SEQ ID NO: 7. In some embodiments, the *V. cholerae* bacterium includes a bacterial chromosome, wherein the bacterial chromosome includes or consists of the nucleic acid sequence of SEQ ID NO: 51. In some embodiments, the *V. cholerae* bacterium includes a first bacterial chromosome and a second bacterial chromosome, wherein the first bacterial chromosome includes or consists of the nucleic acid sequence of SEQ ID NO: 7, and the second bacterial chromosome includes or consists of the nucleic acid sequence of SEQ ID NO: 51. In some embodiments, the *V. cholerae* bacterium has mutations in the same genes, relative to its parental strain, as the strain having ATCC deposit number PTA-125138. In some embodiments, the *Vibrio cholerae* bacterium is a *V. cholerae* strain having ATCC deposit number PTA-125138 (described herein as HaitiV).

Programmable RNA-Guided Nuclease Systems

The disclosure further provides recombinant bacterial strains comprising a programmable RNA-guided nuclease system that specifically targets a gene (e.g., a virulence gene) that was previously deleted from the bacterial strain. By targeting the gene that was deleted from the bacterial strain, reversion of a virulent phenotype by the recombinant bacterium may be prevented and/or ameliorated (e.g., by preventing re-acquisition of the gene). The use of programmable RNA-guided nuclease systems as described herein is particularly useful in live attenuated vaccine bacterial strains in order to maintain the attenuated phenotype of the strains.

Any attenuated bacterial strain can be modified to express a programmable RNA-guided nuclease system to prevent and/or ameliorate reversion to a virulent phenotype. For example, live attenuated bacterial strains of the species *V. cholerae*, *Salmonella enterica*, *Shigella flexneri*, *Shigella sonnei*, *Shigella dysenteriae*, *Bordetella pertussis*, and *Clostridioides difficile* (previously *Clostridium difficile*) can be genetically-manipulated to express a programmable RNA-guided nuclease system targeting a gene that is deleted in the strain (i.e., as compared to the strain from which the attenuated bacterial strain was derived). Exemplary live attenuated bacterial strains and a description of the virulence genes that are deleted in the strains are provided in Table 1. Exemplary sequences of the virulence genes that are deleted in these live attenuated bacterial strains are provided in Table 2. Each of the bacterial strains provided in Table 1 can be genetically modified as described herein to include a RNA-guided nuclease system that specifically targets at least one of the genes that has been deleted in the strain. For example, in some embodiments, the bacterial strain is a *V. cholerae* strain including a deletion in a ctxA gene, as well as a programmable RNA-guided nuclease system (e.g., a heterologous nucleic acid sequence encoding a Cas9 nuclease molecule and a heterologous nucleic acid sequence encoding a guide RNA (gRNA)) targeting a ctxA gene. In some embodiments, the bacterial strain is a *S. enterica* strain including a deletion in at least one virulence gene selected from aroC, aroD, htrA, ssaV, cya, crp, phoP, phoQ, guaB, guaA, clpX, and clpP, as well as a programmable RNA-guided nuclease system targeting at least one of the deleted virulence genes (e.g., aroC, aroD, htrA, ssaV, cya, crp, phoP, phoQ, guaB, guaA, clpX, and clpP). In some embodiments, the bacterial strain is a *S. flexneri* strain including a deletion in at least one virulence gene selected from guaB, guaA, set, sen, virG/icsA, luc, aroA, and msbB2, as well as a programmable RNA-guided nuclease system targeting at least one of the deleted virulence genes (e.g., guaB, guaA, set, sen, virG/icsA, luc, aroA, and msbB2). In some embodiments, the bacterial strain is a *S. dysenteriae* strain including a deletion in at least one virulence gene selected from guaB, guaA, sen, stxA, stxB, and msbB2, as well as a programmable RNA-guided nuclease system targeting at least one of the deleted virulence genes (e.g., guaB, guaA, sen, stxA, stxB, and msbB2). In some embodiments, the bacterial strain is a *S. sonnei* strain including a deletion in a stxA gene and/or a stxB gene, as well as a programmable RNA-guided nuclease system targeting the deleted virulence gene (e.g., stxA and/or stxB). In some embodiments, the bacterial strain is a *B. pertussis* strain including a deletion in a dnt gene, a aroA gene and/or an aroQ gene, as well as a programmable RNA-guided nuclease system targeting the deleted virulence gene (e.g., dnt, aroA and/or aroQ). In some embodiments, the bacterial strain is a *C. difficile* strain including a deletion in a tcdA gene and/or a tcdB gene, as well as a programmable RNA-guided nuclease system targeting the deleted virulence gene (e.g., tcdA and/or tcdB).

In some embodiments, the bacterium is a *V. cholerae* bacterium having a programmable RNA-guided nuclease system that specifically targets a CTXΦ nucleic acid, thereby preventing or interrupting one or more of the following processes: the insertion of CTXΦ genetic material into the bacterial genome, the replication of CTXΦ, the assembly of CTXΦ, and/or the release of CTXΦ from the bacterium; or killing the bacterium comprising an integrated copy of the CTXΦ genome. In some embodiments, the programmable RNA-guided nuclease system targets a ctxA gene.

Relevant nuclease systems that may be used include, but are not limited to: zinc finger nucleases, transcription activator-like effector nucleases (TALENs), CRISPR from *Prevotella* and *Francisella* 1 (Cpf1) nucleases, meganucleases, and CRISPR/Cas9 nuclease systems. As used herein, the term "edits" in reference to a programmable RNA-guided nuclease system includes mutations such as, a point mutation, an insertion, a deletion, a frameshift, or a missense mutation at a target nucleic acid. The RNA-guided nuclease system includes guide RNAs comprising a sequence that is complementary to the sequence of a nucleic acid (i.e., a targeting domain) in the virulence gene (e.g., a gene present in a CTXΦ genome such as ctxA), and a sequence (e.g., a PAM sequence or a direct repeat sequence) that is targetable by a nuclease molecule (e.g., a Cas9 nuclease molecule). The term guide RNA ("gRNA"), as used herein, includes any RNA molecule (e.g., gRNA, crRNA, tracrRNA, sgRNA, and others) guiding a nuclease molecule to a target nucleic acid. Upon successful targeting, the nuclease molecule cleaves the nucleic acid in the virulence gene (e.g., ctxA). By specifically targeting the virulence gene with a programmable RNA-guided nuclease system, the reversion of an attenuated bacterium (e.g., an attenuated *Salmonella enterica* or *V. cholerae* bacterium) to a virulent bacterium may be prevented and/or ameliorated. The term "prevention" refers to any reduction, no matter how slight (e.g., need not be 100% reduction), of the risk that an attenuated bacterium to revert to a virulent form.

In some embodiments, the bacterium includes a heterologous nucleic acid encoding a Cas9 nuclease molecule. Although the present examples exemplify the use of a *Streptococcus pyogenes* Cas9 nuclease molecule (SpCas9), other Cas9 nuclease molecules from other species can also be used (e.g., *Staphylococcus aureus* Cas9 nuclease molecule (SaCas9)), as discussed below. The sequences of multiple Cas9 nuclease molecules, as well as their respective PAM sequences, are known in the art (see, e.g., Kleinstiver et al. (2015) *Nature* 523 (7561): 481-5; Hou et al. (2013) *Proc. Natl. Acad. Sci. U.S.A.*; Fonfara et al. (2014) *Nucleic Acids Res.* 42: 2577-90; Esvelt et al. (2013) *Nat. Methods* 10: 1116-21; Cong et al. (2013) *Science* 339: 819-23; and Horvath et al. (2008) *J. Bacteriol.* 190: 1401-12; PCT Publication Nos. WO 2016/141224, WO 2014/204578, and WO 2014/144761; U.S. Pat. No. 9,512,446; and US Publication No. 2014/0295557; the entire contents of each of which are incorporated herein by reference). Variants of the SpCas9 system can also be used (e.g., truncated sgRNAs (Tsai et al. (2015) *Nat. Biotechnol.* 33: 187-97; Fu et al. (2014) *Nat. Biotechnol.* 32: 279-84), nickase mutations (Mali et al. (2013) *Nat. Biotechnol.* 31: 833-8 (2013); Ran et al. (2013) *Cell* 154: 1380-9), FokI-dCas9 fusions (Guilinger et al. (2014) *Nat. Biotechnol.* 32: 577-82; Tsai et al. (2014) *Nat. Biotechnol.* 32: 569-76; and PCT Publication No. WO 2014/144288; the entire contents of each of which are incorporated herein by reference). The nucleases can include one or more of SpCas9 D1135E variant; SpCas9 VRER variant; SpCas9 EQR variant; SpCas9 VQR variant; *Streptococcus thermophilus* Cas9 nuclease molecule (StCas9); *Treponema denticola* Cas9 nuclease molecule (TdCas9); or *Neisseria meningitidis* Cas9 nuclease molecule (NmCas9), as well as variants thereof that are at least 80%, 85%, 90%, 95%, 96%, 97%, 98%, 99% or 100% identical thereto that retain at least one function of the enzyme from which they are derived, e.g., the ability to complex with a gRNA, bind to target DNA specified by the gRNA, and alter the sequence (e.g., cleave) of the target DNA.

In some embodiments, the bacterium (e.g., a *V. cholerae* bacterium) includes a heterologous nucleic acid encoding a Cpf1 nuclease molecule. Cpf1 is a Cas protein that can be programmed to cleave target DNA sequences (Zetsche et al. (2015) *Cell* 163: 759-71; Schunder et al. (2013) *Int. J. Med. Microbiol.* 303: 51-60; Makarova et al. (2015) *Nat. Rev. Microbiol.* 13: 722-36; Fagerlund et al. (2015) *Genome Biol.* 16: 251). In some embodiments, the Cpf1 nuclease molecule is *Acidaminococcus* sp. BV3L6 (AsCpf1; NCBI Reference Sequence: WP_021736722.1), or a variant thereof. In some embodiments, the Cpf1 nuclease molecule is *Lachnospiraceae bacterium* ND2006 (LbCpf1; GenBank Acc No. WP_051666128.1) or a variant thereof. Unlike SpCas9, Cpf1 requires only a single 42-nt crRNA, which has 23 nt at its 3' end that are complementary to the protospacer of the target DNA sequence (Zetsche et al. (2015)). Furthermore, whereas SpCas9 recognizes an NGG PAM sequence that is 3' of the protospacer, AsCpf1 and LbCp1 recognize TTTN PAMs that are found 5' of the protospacer (Zetsche et al. (2015)). In some embodiments, the Cpf1 nuclease molecule is a variant of a wild-type Cpf1 molecule that is at least 80%, 85%, 90%, 95%, 96%, 97%, 98%, 99% or 100% identical to a wild-type Cpf1 nuclease molecule, and retains at least one function of the enzyme from which it was derived, e.g., the ability to complex with a gRNA, bind to target DNA specified by the gRNA, and alter the sequence (e.g., cleave) of the target DNA To determine the percent identity of two sequences, the sequences are aligned for optimal comparison purposes (gaps are introduced in one or both of a first and a second amino acid or nucleic acid sequence as required for optimal alignment, and non-homologous sequences can be disregarded for comparison purposes). The length of a reference sequence aligned for comparison purposes is at least 80% (in some embodiments, about 85%, 90%, 95%, or 100% of the length of the reference sequence) is aligned. The nucleotides or residues at corresponding positions are then compared. When a position in the first sequence is occupied by the same nucleotide or residue as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. For example, the percent identity between two amino acid sequences can be determined using the Needleman and Wunsch algorithm (see Needleman and Wunsch (1970) *J. Mol. Biol.* 48: 444-53) which has been incorporated into the GAP program in the GCG software package, using a Blossum 62 scoring matrix with a gap penalty of 12, a gap extend penalty of 4, and a frameshift gap penalty of 5.

The amino acid sequence of wild type SpCas9 is as follows:

(SEQ ID NO: 1)
MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD

The amino acid sequence of wild type SaCas9 is as follows:

(SEQ ID NO: 2)
MKRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLSE

EEFSAALLHLAKRRGVHNVNEVEEDTGNELSTKEQISRNSKALEEKYVAEL

QLERLKKDGEVRGSINRFKTSDYVKEAKQLLKVQKAYHQLDQSFIDTYIDL

LETRRTYYEGPGEGSPFGWKDIKEWYEMLMGHCTYFPEELRSVKYAYNADL

YNALNDLNNLVITRDENEKLEYYEKFQIIENVFKQKKKPTLKQIAKEILVN

EEDIKGYRVTSTGKPEFTNLKVYHDIKDITARKEIIENAELLDQIAKILTI

YQSSEDIQEELTNLNSELTQEEIEQISNLKGYTGTHNLSLKAINLILDELW

HINDNQIAIFNRLKLVPKKVDLSQQKEIPTTLVDDFILSPVVKRSFIQSIK

VINAIIKKYGLPNDIIIELAREKNSKDAQKMINEMQKRNRQTNERIEEIIR

TTGKENAKYLIEKIKLHDMQEGKCLYSLEAIPLEDLLNNPFNYEVDHIIPR

SVSFDNSFNNKVLVKQEENSKKGNRTPFQYLSSSDSKISYETFKKHILNLA

KGKGRISKTKKEYLLEERDINRFSVQKDFINRNLVDTRYATRGLMNLLRSY

FRVNNLDVKVKSINGGFTSFLRRKWKFKKERNKGYKHHAEDALIIANADFI

FKEWKKLDKAKKVMENQMFEEKQAESMPEIETEQEYKEIFITPHQIKHIKD

FKDYKYSHRVDKKPNRELINDTLYSTRKDDKGNTLIVNNLNGLYDKDNDKL

KKLINKSPEKLLMYHHDPQTYQKLKLIMEQYGDEKNPLYKYYEETGNYLTK

YSKKDNGPVIKKIKYYGNKLNAHLDITDDYPNSRNKVVKLSLKPYRFDVYL

DNGVYKFVTVKNLDVIKKENYYEVNSKCYEEAKKLKKISNQAEFIASFYNN

DLIKINGELYRVIGVNNDLLNRIEVNMIDITYREYLENMNDKRPPRIIKTI

ASKTQSIKKYSTDILGNLYEVKSKKHPQIIKKG.

In some embodiments, the bacterium includes a heterologous nucleic acid sequence encoding a gRNA, wherein the gRNA includes a targeting domain which is complementary with a target nucleic acid sequence of a virulence gene (e.g., a CTXΦ genome gene such as ctxA). In some embodiments, the gRNA includes a targeting domain which is complementary with a target nucleic acid sequence present on a virulence gene listed in Table 2 (e.g., ctxA, aroD, or htrA). Methods of designing and making gRNAs with specificity for particular targets are known in the art and are described, for example, in Prykhozhij et al. (2015) *PLos One* 10(3): e0119372; Doench et al. (2014) *Nat. Biotechnol.* 32(12):

1262-7; and Graham et al. (2015) *Genome Biol.* 16: 260, each of which are expressly incorporated herein by reference.

V. cholerae Having Programmable RNA-Guided Nuclease Systems

In some embodiments, the virulence gene is a CTXΦ gene and the bacterium is an attenuated *V. cholerae* bacterium. Without wishing to be bound by any particular theory, by specifically targeting a nucleic acid sequence of the CTXΦ genome, it is possible to prevent integration of the CTXΦ genome into the *V. cholerae* bacterial genome and/or maintenance of the CTXΦ genome as a plasmid, either of which may cause the bacterium to adapt and/or revert to a virulent state. The gRNA may comprise a targeting domain complementary with a target nucleic acid sequence present in the CTXΦ genome; however, it is preferable that the gRNA specifically target the nucleic acid sequence of the CTXΦ genome and not a bacterial genome nucleic acid sequence. In some embodiments, the gRNA includes a targeting domain complementary with a target nucleic acid sequence present in a CTXΦ gene (e.g., rstR, rstA, rstB, psh, cep, orfU (gIII), ace, zot, ctxA and ctxB). It is particularly desireable to target ctxA. In some embodiments, the gRNA includes a targeting domain complementary with a target nucleic acid sequence present in a ctxA gene. In some embodiments, the gRNA includes the nucleic acid sequence: 5'-cctgat-gaaataaagcagtcgttttagagctagaaatagcaagt-taaaataaggctagtccgttatcaacttgaaaaagtgg caccgagtcggtgc-3' (SEQ ID NO: 3; targeting sequence specific for ctxA highlighted in bold). In some embodiments, the gRNA includes the nucleic acid sequence 5'-tttttgtcgat-tatcttgctgttctagagagcgggagctcaagttagaataaggctagtccgtat-tcagtgcgggagcacgg caccgattcggtgc-3' (SEQ ID NO: 4; targeting sequence specific for rstA highlighted in bold). In some embodiments, the gRNA includes the nucleic acid sequence 5'-taaacaaagggagcattatagttggagaggcatgagaatgc-caagttccaataaggctagtccgtacacacctaggaga ctaggggcaccgagtcggtgc-3' (SEQ ID NO: 5; targeting sequence specific for ctxA highlighted in bold).

As described above, in some embodiments, the genetically engineered *V. cholerae* bacterium may include a heterologous nucleic acid, wherein the heterologous nucleic acid includes a ctxB gene. Without wishing to be bound by any particular theory, expression of CtxB may induce an anti-ctxB immune response in a subject. This anti-ctxB immune response may protect against diarrheal disease caused by either a virulent *V. cholerae* bacterial strain and/or enterotoxigenic *E. coli* (ETEC) (see, e.g., Kauffman et al. (2016) *MBio.* 7(6): e 02021-16). One of skill in the art will readily appreciate that if the bacterium includes a heterologous nucleic acid comprising a ctxB gene as well as a gRNA comprising a targeting domain complementary with a target nucleic acid sequence present in a ctxB gene, either the heterologous nucleic acid comprising the ctxB gene, or the nucleic acid encoding the gRNA may be genetically engineered such that the gRNA does not target the heterologous nucleic acid comprising the ctxB gene. For example, the heterologous nucleic acid comprising the ctxB gene may be modified to replace a codon sequence with a synonymous codon sequence such that it is not complementary to the gRNA targeting domain sequence.

TABLE 1

Exemplary Live Vaccine Strains

| Bacterial Pathogen | Strain | Vaccine Name | Gene Deletions | Exemplary Sequence(s) from Table 2 | Reference |
|---|---|---|---|---|---|
| *Vibrio cholerae* | VC O1 Inaba 569B | CVD103-HgR | 550 bp of ctxA gene | A | Pastor et al. (2013) *Vaccine* 31: 4069-78. |
| *Vibrio cholerae* | VC strain C7258 El Tor Ogawa | *V. cholerae* 638 | CTX prophage deletion | A | |
| *Vibrio cholerae* | VC O1, El Tor Inaba s | Peru-15 | Cholera toxin encoding core deletion, recA region modification | A | |
| *Salmonella enterica Typhi* | ISP1820 | CVD 906 | ΔaroC ΔaroD | B, C | Tennant and Levine (2015) *Vaccine* 33 Suppl. 3: C36-41. |
| *Salmonella enterica Typhi* | Ty2 | CVD 908 | ΔaroC ΔaroD | B, C | |
| *Salmonella enterica Typhi* | ISP1820 | CVD 906-htrA | ΔaroC ΔaroD ΔhtrA | B, C, D | |
| *Salmonella enterica Typhi* | Ty2 | CVD 908-htrA | ΔaroC ΔaroD ΔhtrA | B, C, D | |
| *Salmonella enterica Typhi* | Ty2 | CVD 909 | ΔaroC ΔaroD Ptac-tviA | B, C | |
| *Salmonella enterica Typhi* | Ty2 | Typhella (M01ZH09) 3927 | ΔaroC ΔssaV | B, E | |
| *Salmonella enterica Typhi* | Ty2 | X3927 | Δcya Δcrp | F, G | |

TABLE 1-continued

Exemplary Live Vaccine Strains

| Bacterial Pathogen | Strain | Vaccine Name | Gene Deletions | Exemplary Sequence(s) from Table 2 | Reference |
|---|---|---|---|---|---|
| Salmonella enterica Typhi | Ty2 | Ty800 | ΔphoPQ | H, I | |
| Salmonella enterica Paratyphi A | ATCC 9150 | CVD 1902 | ΔguaBA ΔclpX | J, K, L | |
| Salmonella enterica Paratyphi A | MGN9772 | MGN10028 | ΔphoPQ | H, I | |
| Salmonella enterica Paratyphi B | CMF 6999 | CVD 2005 | ΔguaBA ΔclpX | J, K, L | |
| Salmonella enterica Typhimurium | I77 | CVD 1921 | ΔguaBA ΔclpP | J, K, M | |
| Salmonella enterica Typhimurium | D65 | CVD 1931 | ΔguaBA ΔclpX | J, K, L | |
| Salmonella enterica Enteritidis | R11 | CVD 1941 | ΔguaBA ΔclpP | J, K, M | |
| Salmonella enterica Enteritidis | R11 | CVD 1944 | ΔguaBA ΔclpX | J, K, L | |
| Shigella flexneri | 2457T | CVD 1207 | ΔguaBA Δset Δsen ΔvirG | N, O, P, Q, R | Mani et al. (2016) |
| Shigella flexneri | 2457T | CVD 1208 | ΔguaBA Δset Δsen | N, O, P, Q | Vaccine 34: 2887-94. |
| Shigella flexneri | 2457T | CVD 1208S | ΔguaBA Δset Δsen | N, O, P, Q | |
| Shigella flexneri | J17B | CVD 1213 | ΔguaBA | N, O | |
| Shigella flexneri | CCH060 | CVD 1215 | ΔguaBA | N, O | |
| Shigella flexneri | 2457T | SC602 | ΔicsA Δluc | R, S | |
| Shigella flexneri | 2457T | CVD 1203 | ΔaroA ΔvirG | R, T | |
| Shigella sonnei | Moseley | WRSs1 | ΔvirG | R | |
| Shigella sonnei | Moseley | WRSs2 | ΔvirG ΔsenA ΔsenB | Q, R | |
| Shigella sonnei | Moseley | WRSs3 | ΔvirG ΔsenA ΔsenB ΔmsbB2 | Q, R, U | |
| Shigella dysenteriae | 1617 | CVD 1251 | ΔguaBA | N, O | |
| Shigella dysenteriae | 1617 | CVD 1254 | ΔstxAB | V, W | |
| Shigella dysenteriae | 1617 | CVD 1255 | ΔguaBA Δsen ΔstxAB | N, O, V, W | |
| Shigella dysenteriae | 1617 | CVD 1256 | ΔguaBA Δsen ΔstxAB::mLpp-stxB | N, O, V, W | |
| Shigella dysenteriae | 1617 | CVD 1257 | ΔguaBA Δsen ΔstxAB::trc-stxB | N, O, V, W | |
| Shigella dysenteriae | 1617 | CVD 1258 | ΔguaBA Δsen ΔstxAB pOmpC-StxB | N, O, V, W | |
| Shigella dysenteriae | 1617 | CVD 1259 | ΔguaBA Δsen ΔstxAB pTrc-StxB | N, O, V, W | |
| Bordetella pertussis | 12822 | BPZE1 | ΔampG::Ec_ampG Δptx::ptx* Δdnt | X, Y | Locht (2017) |
| Bordetella pertussis | CN2992 FS | aroA | aroA | Z | Vaccine pii: |
| Bordetella pertussis | BP1 | aroA | aroA | Z | S0264-410X(17) |

TABLE 1-continued

Exemplary Live Vaccine Strains

| Bacterial Pathogen | Strain | Vaccine Name | Gene Deletions | Exemplary Sequence(s) from Table 2 | Reference |
|---|---|---|---|---|---|
| *Bordetella pertussis* | ATCC 9340 | aroQBP | aroQ::kan | AA | 31619-5 (doi: 10.1016/j.vaccine.2017) |

TABLE 2

Deleted Virulence Genes from Exemplary Live Vaccine Strains

| Exemplary Sequences | Virulence Gene | Nucleotide Accession | Start | Stop | Strand | Protein | Organism | Assembly |
|---|---|---|---|---|---|---|---|---|
| A | ctxA | NC_002505.1 | 1567338 | 1568114 | − | WP_001881225.1 | *Vibrio cholerae* O1 biovar El Tor str. N16961 | GCF_000006745.1 |
| | ctxA | NC_009456.1 | 566372 | 567148 | + | WP_001881225.1 | *Vibrio cholerae* O395 | GCF_000016245.1 |
| | ctxA | NC_009457.1 | 1115147 | 1115923 | − | WP_001881225.1 | *Vibrio cholerae* O395 | GCF_000016245.1 |
| | ctxA | NC_012582.1 | 1646566 | 1647342 | − | WP_001881225.1 | *Vibrio cholerae* O395 | GCF_000021625.1 |
| | ctxA | NC_012583.1 | 696794 | 697570 | − | WP_001881225.1 | *Vibrio cholerae* O395 | GCF_000021625.1 |
| B | aroC | NC_003198.1 | 2449561 | 2450646 | − | WP_000918475.1 | *Salmonella enterica* subsp. *enterica* serovar *Typhi* str. CT18 | GCF_000195995.1 |
| | aroC | NC_004631.1 | 554066 | 555151 | + | WP_000918475.1 | *Salmonella enterica* subsp. *enterica* serovar Typhi str. Ty2 | GCF_000007545.1 |
| | aroC | NC_016832.1 | 554020 | 555105 | + | WP_000918475.1 | *Salmonella enterica* subsp. *enterica* serovar Typhi str. P-stx-12 | GCF_000245535.1 |
| | aroC | NC_021176.1 | 554066 | 555151 | + | WP_000918475.1 | *Salmonella enterica* subsp. *enterica* serovar Typhi str. Ty21a | GCF_000385905.1 |
| | aroC | NZ_AJGK01000087.1 | 3952 | 5037 | − | WP_000918475.1 | *Salmonella enterica* subsp. *enterica* serovar Typhi str. BL196 | GCF_000256015.1 |
| C | aroD | NC_003198.1 | 1681680 | 1682438 | + | WP_000860215.1 | *Salmonella enterica* subsp. *enterica* serovar Typhi str. CT18 | GCF_000195995.1 |
| | aroD | NC_004631.1 | 1298692 | 1299450 | − | WP_000860215.1 | *Salmonella enterica* subsp. enterica serovar Typhi str. Ty2 | GCF_000007545.1 |
| | aroD | NC_016832.1 | 1297665 | 1298423 | − | WP_000860215.1 | *Salmonella enterica* subsp. *enterica* serovar Typhi str. P-stx-12 | GCF_000245535.1 |
| | aroD | NC_021176.1 | 1298692 | 1299450 | − | WP_000860215.1 | *Salmonella enterica* subsp. enterica serovar Typhi str. Ty21a | GCF_000385905.1 |
| | aroD | NZ_AESR01000018.1 | 161153 | 161911 | − | WP_000860215.1 | *Salmonella enterica* subsp. *enterica* serovar Montevideo str. SARB31 | GCF_000238555.1 |
| D | htrA | NC_003198.1 | 241500 | 242927 | + | WP_000753959.1 | *Salmonella enterica* subsp. *enterica* serovar *Typhi* str. CT18 | GCF_000195995.1 |
| | htrA | NC_004631.1 | 241491 | 242918 | + | WP_000753959.1 | *Salmonella enterica* subsp. *enterica* serovar Typhi str. Ty2 | GCF_000007545.1 |

TABLE 2-continued

Deleted Virulence Genes from Exemplary Live Vaccine Strains

| Exemplary Sequences | Virulence Gene | Nucleotide Accession | Start | Stop | Strand | Protein | Organism | Assembly |
|---|---|---|---|---|---|---|---|---|
| | htrA | NC_016832.1 | 241500 | 242927 | + | WP_000753959.1 | Salmonella enterica subsp. enterica serovar Typhi str. P-stx-12 | GCF_000245535.1 |
| | htrA | NC_021176.1 | 241491 | 242918 | + | WP_000753959.1 | Salmonella enterica subsp. enterica serovar Typhi str. Ty21a | GCF_000385905.1 |
| | htrA | NZ_AJGK01000045.1 | 8167 | 9594 | + | WP_000753959.1 | Salmonella enterica subsp. enterica serovar Typhi str. BL196 | GCF_000256015.1 |
| E | ssaV | NC_003198.1 | 1631029 | 1633074 | − | WP_001258227.1 | Salmonella enterica subsp. enterica serovar Typhi str. CT18 | GCF_000195995.1 |
| | ssaV | NC_004631.1 | 1348062 | 1350107 | + | WP_001258227.1 | Salmonella enterica subsp. enterica serovar Typhi str. Ty2 | GCF_000007545.1 |
| | ssaV | NC_016832.1 | 1347035 | 1349080 | + | WP_001258227.1 | Salmonella enterica subsp. enterica serovar Typhi str. P-stx-12 | GCF_000245535.1 |
| | ssaV | NC_021176.1 | 1348062 | 1350107 | + | WP_001258227.1 | Salmonella enterica subsp. enterica serovar Typhi str. Ty21a | GCF_000385905.1 |
| | ssaV | NZ_AJGK01000084.1 | 82395 | 84440 | + | WP_001258227.1 | Salmonella enterica subsp. enterica serovar Typhi str. BL196 | GCF_000256015.1 |
| F | cya | NC_003197.2 | 4146380 | 4148926 | + | WP_000281718.1 | Salmonella enterica subsp. enterica serovar Typhimurium str. LT2 | GCF_000006945.2 |
| | cya | NC_003198.1 | 3472059 | 3474605 | − | WP_000281718.1 | Salmonella enterica subsp. enterica serovar Typhi str. CT18 | GCF_000195995.1 |
| | cya | NC_004631.1 | 3457717 | 3460263 | − | WP_000281718.1 | Salmonella enterica subsp. enterica serovar Typhi str. Ty2 | GCF_000007545.1 |
| | cya | NC_010102.1 | 4091813 | 4094359 | + | WP_000281718.1 | Salmonella enterica subsp. enterica serovar Paratyphi B str. SPB7 | GCF_000018705.1 |
| | cya | NC_011080.1 | 4112677 | 4115223 | + | WP_000281718.1 | Salmonella enterica subsp. enterica serovar Newport str. SL254 | GCF_000016045.1 |
| G | crp | NC_003198.1 | 4213325 | 4213957 | − | WP_000242746.1 | Salmonella enterica subsp. enterica serovar Typhi str. CT18 | GCF_000195995.1 |
| | crp | NC_004631.1 | 4197972 | 4198604 | − | WP_000242746.1 | Salmonella enterica subsp. enterica serovar Typhi str. Ty2 | GCF_000007545.1 |
| | crp | NC_016832.1 | 4186495 | 4187127 | − | WP_000242746.1 | Salmonella enterica subsp. enterica serovar Typhi str. P-stx-12 | GCF_000245535.1 |
| | crp | NC_021176.1 | 4197969 | 4198601 | − | WP_000242746.1 | Salmonella enterica subsp. enterica serovar Typhi str. Ty21a | GCF_000385905.1 |
| | crp | NZ_AJGK01000029.1 | 11626 | 12258 | − | WP_000242746.1 | Salmonella enterica subsp. enterica serovar Typhi str. BL196 | GCF_000256015.1 |
| H | phoP | NC_003198.1 | 1228174 | 1228848 | − | WP_000986523.1 | Salmonella enterica subsp. enterica serovar Typhi str. CT18 | GCF_000195995.1 |

TABLE 2-continued

Deleted Virulence Genes from Exemplary Live Vaccine Strains

| Exemplary Sequences | Virulence Gene | Nucleotide Accession | Start | Stop | Strand | Protein | Organism | Assembly |
|---|---|---|---|---|---|---|---|---|
| | phoP | NC_004631.1 | 1752335 | 1753009 | + | WP_000986523.1 | Salmonella enterica subsp. enterica serovar Typhi str. Ty2 | GCF_000007545.1 |
| | phoP | NC_016832.1 | 1749370 | 1750044 | + | WP_000986523.1 | Salmonella enterica subsp. enterica serovar Typhi str. P-stx-12 | GCF_000245535.1 |
| | phoP | NC_021176.1 | 1752335 | 1753009 | + | WP_000986523.1 | Salmonella enterica subsp. enterica serovar Typhi str. Ty21a | GCF_000385905.1 |
| | phoP | NZ_AJGK01000079.1 | 6353 | 7027 | + | WP_000986523.1 | Salmonella enterica subsp. enterica serovar Typhi str. BL196 | GCF_000256015.1 |
| I | phoQ | NC_003198.1 | 1226711 | 1228174 | − | WP_001031689.1 | Salmonella enterica subsp. enterica serovar Typhi str. CT18 | GCF_000195995.1 |
| | phoQ | NC_004631.1 | 1753009 | 1754472 | + | WP_001031689.1 | Salmonella enterica subsp. enterica serovar Typhi str. Ty2 | GCF_000007545.1 |
| | phoQ | NC_016832.1 | 1750044 | 1751507 | + | WP_001031689.1 | Salmonella enterica subsp. enterica serovar Typhi str. P-stx-12 | GCF_000245535.1 |
| | phoQ | NC_021176.1 | 1753009 | 1754472 | + | WP_001031689.1 | Salmonella enterica subsp. enterica serovar Typhi str. Ty21a | GCF_000385905.1 |
| | phoQ | NZ_AJGK01000079.1 | 7027 | 8490 | + | WP_001031689.1 | Salmonella enterica subsp. enterica serovar Typhi str. BL196 | GCF_000256015.1 |
| J | guaB | NC_003198.1 | 2589318 | 2590790 | − | WP_001132127.1 | Salmonella enterica subsp. enterica serovar Typhi str. CT18 | GCF_000195995.1 |
| | guaB | NC_021812.2 | 3113815 | 3115287 | − | WP_001132127.1 | Salmonella enterica subsp. enterica serovar Heidelberg str. CFSAN002069 | GCF_000430085.2 |
| | guaB | NC_021814.1 | 890857 | 892329 | + | WP_001132127.1 | Salmonella enterica subsp. enterica serovar Typhimurium var. 5-str. CFSAN001921 | GCF_000430145.2 |
| | guaB | NZ_AHUK01000009.1 | 71638 | 73110 | + | WP_001132127.1 | Salmonella enterica subsp. enterica serovar Dublin | GCF_000336035.1 |
| | guaB | AE014613.1 | 414059 | 415531 | + | AA068066.1 | Salmonella enterica subsp. enterica serovar Typhi str. Ty2 | GCA_000007545.1 |
| K | guaA | NC_003198.1 | 2587671 | 2589248 | − | WP_000138293.1 | Salmonella enterica subsp. enterica serovar Typhi str. CT18 | GCF_000195995.1 |
| | guaA | NC_004631.1 | 415601 | 417178 | + | WP_000138293.1 | Salmonella enterica subsp. enterica serovar Typhi str. Ty2 | GCF_000007545.1 |
| | guaA | NC_011083.1 | 2679482 | 2681059 | − | WP_000138293.1 | Salmonella enterica subsp. enterica serovar Heidelberg str. SL476 | GCF_000020705.1 |
| | guaA | NC_011149.1 | 2590289 | 2591866 | − | WP_000138293.1 | Salmonella enterica subsp. enterica serovar Agona str. SL483 | GCF_000020885.1 |
| | guaA | NC_011205.1 | 2751892 | 2753469 | − | WP_000138293.1 | Salmonella enterica subsp. enterica serovar Dublin str. CT_02021853 | GCF_000020925.1 |

TABLE 2-continued

Deleted Virulence Genes from Exemplary Live Vaccine Strains

| Exemplary Sequences | Virulence Gene | Nucleotide Accession | Start | Stop | Strand | Protein | Organism | Assembly |
|---|---|---|---|---|---|---|---|---|
| L | clpX | NC_003198.1 | 496233 | 497504 | + | WP_000130316.1 | Salmonella enterica subsp. enterica serovar Typhi str. CT18 | GCF_000195995.1 |
| | clpX | NC_004631.1 | 2483597 | 2484868 | − | WP_000130316.1 | Salmonella enterica subsp. enterica serovar Typhi str. Ty2 | GCF_000007545.1 |
| | clpX | NC_016832.1 | 2480497 | 2481768 | − | WP_000130316.1 | Salmonella enterica subsp. enterica serovar Typhi str. P-stx-12 | GCF_000245535.1 |
| | clpX | NC_021176.1 | 2483597 | 2484868 | − | WP_000130316.1 | Salmonella enterica subsp. enterica serovar Typhi str. Ty21a | GCF_000385905.1 |
| | clpX | NZ_AJGK01000075.1 | 9768 | 11039 | − | WP_000130316.1 | Salmonella enterica subsp. enterica serovar Typhi str. BL196 | GCF_000256015.1 |
| M | clpP | NC_003197.2 | 503211 | 503834 | + | WP_000122257.1 | Salmonella enterica subsp. enterica serovar Typhimurium str. LT2 | GCF_000006945.2 |
| | clpP | NC_003198.1 | 495358 | 495981 | + | WP_000122257.1 | Salmonella enterica subsp. enterica serovar Typhi str. CT18 | GCF_000195995.1 |
| | clpP | NC_004631.1 | 2485120 | 2485743 | − | WP_000122257.1 | Salmonella enterica subsp. enterica serovar Typhi str. Ty2 | GCF_000007545.1 |
| | clpP | NC_006905.1 | 547568 | 548191 | + | WP_000122257.1 | Salmonella enterica subsp. enterica serovar Choleraesuis str. SC-B67 | GCF_000008105.1 |
| | clpP | NC_010102.1 | 2614575 | 2615198 | − | WP_000122257.1 | Salmonella enterica subsp. enterica serovar Paratyphi B str. SPB7 | GCF_000018705.1 |
| N | guaB | AE005674.2 | 2622056 | 2623522 | − | AAN44054.2 | Shigella flexneri 2a str. 301 | GCA_000006925.2 |
| | guaB | AE014073.1 | 2615645 | 2617111 | − | AAP17881.1 | Shigella flexneri 2a str. 2457T | GCA_000007405.1 |
| | guaB | CP004056.1 | 2623964 | 2625430 | − | AIL36801.1 | Shigella flexneri 2003036 | GCA_000743955.1 |
| | guaB | CP004057.1 | 2647737 | 2649203 | − | AIL41744.1 | Shigella flexneri Shi06HN006 | GCA_000743995.1 |
| | guaB | CP007037.1 | 2619532 | 2620998 | − | AKK55078.1 | Shigella flexneri G1663 | GCA_001021855.1 |
| O | guaA | AE005674.2 | 2620410 | 2621987 | − | AAN44053.1 | Shigella flexneri 2a str. 301 | GCA_000006925.2 |
| | guaA | AE014073.1 | 2613999 | 2615576 | − | AAP17880.1 | Shigella flexneri 2a str. 2457T | GCA_000007405.1 |
| | guaA | CP001383.1 | 2658104 | 2659681 | − | ADA74893.1 | Shigella flexneri 2002017 | GCA_000022245.1 |
| | guaA | CP004056.1 | 2622318 | 2623895 | − | AIL36800.1 | Shigella flexneri 2003036 | GCA_000743955.1 |
| | guaA | CP004057.1 | 2646091 | 2647668 | − | AIL41743.1 | Shigella flexneri Shi06HN006 | GCA_000743995.1 |
| P | set | CP020339.1 | 2383407 | 2387525 | − | ASQ58270.1 | Shigella flexneri 4c | GCA_002240095.1 |
| | set | CP020342.1 | 1888927 | 1893045 | + | ASQ62198.1 | Shigella flexneri 1a | GCA_002240115.1 |
| | set | CP020086.1 | 1341206 | 1345324 | + | ASQ80894.1 | Shigella flexneri 1a | GCA_002240135.1 |
| | set | CELV01000023.1 | 726 | 4844 | + | CFW93500.1 | Shigella flexneri 2a | GCA_001078805.1 |
| | set | NC_004337.2 | 3067737 | 3071855 | − | NP708747.3 | Shigella flexneri 2a str. 301 | GCF_000006925.2 |
| Q | sen | Z54211.1 | 228 | 1925 | − | CAA90938.1 | Shigella flexneri | N/A |
| | sen | CELV01000168.1 | 436 | 2133 | − | CEP59611.1 | Shigella flexneri 2a | GCA_001078805.1 |
| R | virG/icsA | AF386526.1 | 149644 | 152952 | + | AAL72293.1 | Shigella flexneri 2a str. 301 | GCA_000006925.2 |
| | virG/icsA | CP001384.1 | 148306 | 151614 | + | ADA76922.1 | Shigella flexneri 2002017 | GCA_000022245.1 |

TABLE 2-continued

Deleted Virulence Genes from Exemplary Live Vaccine Strains

| Exemplary Sequences | Virulence Gene | Nucleotide Accession | Start | Stop | Strand | Protein | Organism | Assembly |
|---|---|---|---|---|---|---|---|---|
| | virG/icsA | CP012138.1 | 69094 | 72402 | + | AMN60991.1 | Shigella flexneri 2a | GCA_001580175.1 |
| | virG/icsA | CP012142.1 | 146971 | 150279 | + | AMN66151.1 | Shigella flexneri 4c | GCA_001579965.1 |
| | virG/icsA | CELV01000134.1 | 745 | 4053 | − | CEP59383.1 | Shigella flexneri 2a | GCA_001078805.1 |
| S | luc | CP012137.1 | 3863156 | 3864880 | + | AMN59975.1 | Shigella flexneri 2a | GCA_001580175.1 |
| | luc | CP012140.1 | 3884571 | 3886295 | + | AMN64802.1 | Shigella flexneri 4c | GCA_001579965.1 |
| | luc | CELV01000103.1 | 2191 | 3915 | + | CEP59060.1 | Shigella flexneri 2a | GCA_001078805.1 |
| | luc | ADUV01000056.1 | 8414 | 10138 | − | EFS11898.1 | Shigella flexneri 2a str. 2457T | GCA_000183785.2 |
| | luc | AFHA01000080.1 | 89681 | 91405 | − | EGJ80976.1 | Shigella flexneri K-671 | GCA_000213435.2 |
| T | aroA | AE005674.2 | 941164 | 942447 | + | AAN42533.1 | Shigella flexneri 2a str. 301 | GCA_000006925.2 |
| | aroA | AE014073.1 | 945133 | 946416 | + | AAP16419.1 | Shigella flexneri 2a str. 2457T | GCA_000007405.1 |
| | aroA | CP000266.1 | 948101 | 949384 | + | ABF03130.1 | Shigella flexneri 5 str. 8401 | GCA_000013585.1 |
| | aroA | CP001383.1 | 950854 | 952137 | + | ADA73251.1 | Shigella flexneri 2002017 | GCA_000022245.1 |
| | aroA | CP004057.1 | 937946 | 939229 | + | AIL39820.1 | Shigella flexneri Shi06HN006 | GCA_000743995.1 |
| U | msbB2 | NC_002698.1 | 186010 | 186954 | + | WP_004996485.1 | Shigella flexneri 5a str. M9OT | (not assembled) |
| | msbB2 | NC_004851.1 | 194662 | 195606 | + | WP_004996485.1 | Shigella flexneri 2a str. 301 | GCF_000006925.2 |
| | msbB2 | NC_007607.1 | 89045 | 89989 | + | WP_004996485.1 | Shigella dysenteriae Sd197 | GCF_000012005.1 |
| | msbB2 | NC_019197.1 | 60218 | 61162 | − | WP_004996485.1 | Shigella flexneri | (not assembled) |
| | msbB2 | NZ_AMJQ01000012.1 | 6035 | 6979 | + | WP_004996485.1 | Shigella dysenteriae S6205 | GCF_000815495.1 |
| V | sbcA | NZ_LRRZ01000024.1 | 29025 | 29972 | + | WP_000691354.1 | Shigella sonnei | GCF_001689325.1 |
| | sbcA | CP021144.1 | 168684 | 169631 | + | ARR38645.1 | Shigella sonnei | GCA_002142635.1 |
| | sbcA | CP019689.1 | 4375543 | 4376490 | + | ARS08249.1 | Shigella sonnei | GCA_002150905.1 |
| | sbcA | AJ132761.1 | 94 | 1041 | + | CAA10763.1 | Shigella sonnei | (not assembled) |
| | sbcA | LRSA01000144.1 | 17112 | 18059 | − | OCC38201.1 | Shigella sonnei | GCA_001688545.1 |
| W | stxB | CP021144.1 | 169641 | 169910 | + | ARR38646.1 | Shigella sonnei | GCA_002142635.1 |
| | stxB | CP019689.1 | 4376500 | 4376769 | + | ARS08250.1 | Shigella sonnei | GCA_002150905.1 |
| | stxB | AJ132761.1 | 1051 | 1320 | + | CAA10764.1 | Shigella sonnei | (not assembled) |
| | stxB | LRSA01000144.1 | 16833 | 17102 | − | OCC38200.1 | Shigella sonnei | GCA_001688545.1 |
| | stxB | LRSB01000051.1 | 16789 | 17058 | − | OCC40513.1 | Shigella sonnei | GCA_001688555.1 |
| X | ampG | CP010323.1 | 51278 | 52489 | + | AJB24935.1 | Bordetella pertussis 137 | GCA_000812165.1 |
| | ampG | HE965805.1 | 3509999 | 3511210 | − | CCJ64643.1 | Bordetella pertussis 18323 | GCA_000306945.1 |
| | ampG | AXSU02000044.1 | 5852 | 7063 | + | ETH01795.1 | Bordetella pertussis 2250905 | GCA_000479635.2 |
| | ampG | AXST02000095.1 | 150 | 1361 | + | ETH04444.1 | Bordetella pertussis 2356847 | GCA_000479655.2 |
| | ampG | AXSS02000025.1 | 156 | 1367 | + | ETH09488.1 | Bordetella pertussis 2371640 | GCA_000479735.2 |
| Y | dnt | NZ_NXFD01000089.1 | 8703 | 13097 | − | WP_010931478.1 | Bordetella pertussis | GCF_002406875.1 |
|

TABLE 2-continued

Deleted Virulence Genes from Exemplary Live Vaccine Strains

| Exemplary Sequences | Virulence Gene | Nucleotide Accession | Start | Stop | Strand | Protein | Organism | Assembly |
|---|---|---|---|---|---|---|---|---|
| | dnt | NZ_CFWW01000036.1 | 2110 | 6504 | + | WP_010931478.1 | Bordetella pertussis | GCF_001333495.1 |
| Z | aroA | NC_002929.2 | 986558 | 987886 | + | WP_010930099.1 | Bordetella pertussis Tohama I | GCF_000195715.1 |
| | aroA | NC_017223.1 | 1010147 | 1011475 | + | WP_010930099.1 | Bordetella pertussis CS | GCF_000212975.1 |
| | aroA | NC_018518.1 | 1405318 | 1406646 | + | WP_010930099.1 | Bordetella pertussis 18323 | GCF_000306945.1 |
| | aroA | NZ_ADKR01000103.1 | 10731 | 12059 | + | WP_010930099.1 | Bordetella pertussis B0558 | GCF_000193515.1 |
| | aroA | NZ_ADKS01000376.1 | 10733 | 12061 | + | WP_010930099.1 | Bordetella pertussis B1193 | GCF_000193535.1 |
| AA | aroQ | NC_002927.3 | 4677939 | 4678373 | − | WP_003814953.1 | Bordetella bronchiseptica RB50 | GCF_000195675.1 |
| | aroQ | NC_002928.3 | 4243092 | 4243526 | − | WP_003814953.1 | Bordetella parapertussis 12822 | GCF_000195695.1 |
| | aroQ | NC_002929.2 | 3189581 | 3190015 | − | WP_003814953.1 | Bordetella pertussis Tohama I | GCF_000195715.1 |
| | aroQ | NC_017223.1 | 3229800 | 3230234 | − | WP_003814953.1 | Bordetella pertussis CS | GCF_000212975.1 |
| | aroQ | NC_018518.1 | 3117828 | 3118262 | − | WP_003814953.1 | Bordetella pertussis 18323 | GCF_000306945.1 |
| BB | tcdA | AM180355.1 | 795843 | 803975 | + | CAJ67494.1 | Clostridioides difficile 630 | GCA_000009205.2 |
| | tcdA | FULU01000004.1 | 183105 | 191237 | + | SJ024242.1 | Clostridioides difficile VRECD0137 | GCA_900164045.1 |
| | tcdA | FUMVV01000003.1 | 126069 | 134201 | + | SJP00148.1 | Clostridioides difficile VRECD0039 | GCA_900164375.1 |
| | tcdA | FUOD01000003.1 | 183261 | 191393 | + | SJQ51066.1 | Clostridioides difficile VRECD0053 | GCA_900164815.1 |
| | tcdA | FUOR01000003.1 | 408706 | 416838 | − | SJQ80390.1 | Clostridioides difficile VRECD0100 | GCA_900164945.1 |
| CC | tcdB | AM180355.1 | 787393 | 794493 | + | CAJ67492.1 | Clostridioides difficile 630 | GCA_000009205.2 |
| | tcdB | AVGL01000018.1 | 25017 | 32117 | + | EQE11947.1 | Clostridioides difficile CD13 | GCA_000448885.2 |
| | tcdB | AVIE01000188.1 | 409 | 7509 | + | EQF85571.1 | Clostridioides difficile CD196 | GCA_000449605.2 |
| | tcdB | AVLC01000039.1 | 15891 | 22991 | + | EQI61286.1 | Clostridioides difficile Y266 | GCA_000451185.2 |
| | tcdB | AVMNO1000011.1 | 46819 | 53919 | + | EQJ95904.1 | Clostridioides difficile P49 | GCA_000451945.2 |

Methods of Use

A further aspect encompasses methods of using a genetically engineered bacterium provided herein (e.g., a genetically engineered *V. cholerae* bacterium). For instance, in some embodiments provided herein are methods for modulating a subject's immune system by administering a genetically engineered described herein to the subject (e.g., orally). The method includes administering to the subject (e.g., a human subject) an effective amount of a composition comprising a genetically engineered bacterium described herein. One of skill in the art will appreciate that an effective amount of a composition is an amount that will generate the desired response (e.g., a protective response, a mucosal response, a humoral response, or a cellular response). The response can be quantitated by methods known in the art.

In some embodiments, provided herein are methods of inducing a protective response against a virulent strain of *Vibrio cholerae* in a subject, the method comprising administering a genetically modified *V. cholerae* bacterium described herein, or a pharmaceutical composition comprising a genetically modified *V. cholerae* bacterium described herein. In some embodiments, the protective response is developed within about 12 hours, about 18 hours, about 24 hours, about 36 hours, about 48 hours, about 60 hours, about 72 hours, or about 84 hours after administration of the genetically modified bacterium of the pharmaceutical composition to the subject. In some embodiments, the protective immune response is developed within 12 hours, 18 hours, 24 hours, 36 hours, 48 hours, 60 hours, 72 hours, 84 hours, or more after administration of the genetically modified bacterium of the pharmaceutical composition to the subject.

In a further embodiment, the genetically engineered *V. cholerae* bacteria described herein may be used in a method for ameliorating one or more symptoms of cholera in a host in need thereof. Cholera symptoms include diarrhea, nausea, vomiting, and dehydration. The method includes administering an effective amount of a composition comprising a genetically engineered *V. cholerae* bacterium described herein.

The genetically engineered bacteria described herein and compositions comprising the bacteria may be administered to any subject. Exemplary vaccine composition formulations comprising the genetically engineered bacteria and methods of administration are detailed below.

Pharmaceutical Compositions

Pharmaceutical compositions comprising a genetically engineered bacterium described herein may optionally comprise one or more possible pharmaceutically acceptable excipients, such as carriers, preservatives, cryoprotectants (e.g., sucrose and trehalose), stabilizers, adjuvants, and other substances. For example, when the composition includes genetically engineered bacteria that are alive, excipients are chosen such that the live bacterium is not killed, or such that the ability of the bacteria to effectively colonize a subject is not compromised by the use of excipients. Suitable pharmaceutical carriers are known in the art and, for example, include liquid carriers, such as normal saline and other non-toxic salts at or near physiological concentrations, and solid carriers, such as talc and sucrose. In some embodiments, the pharmaceutical composition includes an adjuvant. In some embodiments, the pharmaceutical composition may be a in a form suitable for aerosolized administration to a subject. In some embodiments, the pharmaceutical formulation is in a freeze-dried form (i.e., lyophilized form). In some embodiments, the pharmaceutical formulation is a gelatin capsule. Suitable pharmaceutical carriers and adjuvants and the preparation of dosage forms are described in, *Remington's Pharmaceutical Sciences*, 17th Edition, (Gennaro, Ed., Mack Publishing Co., Easton, Pa., 1985), which is herein incorporated by reference.

Administration of the genetically engineered bacteria described herein to a subject can be by any known technique, including, but not limited to oral administration, rectal administration, vaginal administration, or nasal administration.

The dosages of the genetically engineered bacteria that is administered to a subject can and will vary depending on the genetically engineered bacterium, the route of administration, and the intended subject, as will be appreciated by one of skill in the art. Generally speaking, the dosage need only be sufficient to elicit a protective host response in the subject. For example, typical dosages for oral administration could be about $1 \times 10^7$ to $1 \times 10^{10}$ colony forming units (CFU) depending upon the age of the subject to whom the bacteria will be administered. Administering multiple dosages of the genetically engineered bacteria may also be used as needed to provide the desired level of protection.

Kits comprising a genetically engineered bacterium or a pharmaceutical composition described herein are also provided. In some embodiments, the kit further includes instructions for use. In some embodiments, the pharmaceutical composition is lyophilized such that addition of a hydrating agent (e.g., buffered saline) reconstitutes the composition to generate a pharmaceutical composition suitable for administration to a subject (e.g., orally).

The following examples are included to demonstrate preferred embodiments of the invention. It should be appreciated by those of skill in the art that the techniques disclosed in the examples that follow represent techniques discovered by the inventors to function well in the practice of the invention. Those of skill in the art should, however, in light of the present disclosure, appreciate that many changes can be made in the specific embodiments that are disclosed and still obtain a like or similar result without departing from the spirit and scope of the invention, therefore all matter set forth or shown in the accompanying drawings is to be interpreted as illustrative and not in a limiting sense.

EXAMPLES

The invention is further described in the following examples, which do not limit the scope of the invention described in the claims.

Example 1. A Genetically Engineered *Vibrio cholerae* Bacterial Strain Confers Resistance Against Virulent Strains of *V. cholerae* within One Day of Administration The massive and ongoing cholera epidemics in Yemen and Haiti illustrate that this ancient diarrheal disease remains a significant threat to public health (Balakrishnan (2017) *Lancet Infect. Dis.* 17, 700-1; and Ali et al. (2015) *PLoS Negl. Trop Dis.* 9, e0003832). Cholera results from ingesting water or food contaminated by *Vibrio cholerae*, a Gram-negative bacterial pathogen. *V. cholerae* colonizes the small intestine where it produces cholera toxin, which induces profuse watery diarrhea and consequent dehydration that can be rapidly fatal in the absence of rehydration therapy (Clemens et al. (2017) *Lancet* 390(10101): 1539-49). Public health interventions to limit cholera dissemination are critical because of the otherwise rampant spread of cholera epidemics, particularly in association with disruptions in sanitation infrastructure and water supplies. Oral cholera vaccines (OCVs) consisting of killed whole *V. cholerae* cells have modest protective efficacy in endemic regions (Qadri et al. (2015) *Lancet* 386(10001): 1362-71), and these vaccines were recently deployed during outbreaks in non-endemic areas as part of 'reactive vaccination' programs aimed at blocking the spread of cholera (see, e.g., Luquero et al. (2014) *N. Engl. J. Med.* 370(22): 2111-20). However, optimal efficacy of killed OCVs requires 2 refrigerated doses administered 14 days apart (see, e.g., Kabir (2014) *Clin. Vaccine Immunol.* 21(9): 1195-1205), and these features may limit the capacity of the killed OCVs to rapidly constrain ongoing outbreaks in destabilized or resource-limited settings. Single dose live attenuated OCVs showed efficacy in challenge studies (see e.g., Chen et al. (2016) *Clin. Infect. Dis.* 62(11): 1329-35) and early phase clinical trials in endemic regions (Qadri et al. (2007) *Vaccine* 25(2): 231-8), and reactive vaccination with a live attenuated OCV may have contributed to a decrease in the incidence of cholera during an outbreak (see Calain et al. (2004) *Vaccine* 22(19): 2444-51). However, no live OCVs are based on globally predominant 'variant' El Tor strains, like that responsible for the 2010 Haitian cholera outbreak (see Chin et al. (2011) *N. Engl. J. Med.* 364(1): 33-42). Furthermore, no killed or live attenuated OCV has been shown to mediate rapid (e.g., within 24 hours of administration) protection against cholera; instead current vaccines are thought to require the time necessary to elicit a protective adaptive immune response (a minimum of 1 week), to engender protection against cholera. This example describes the generation of a new live attenuated cholera vaccine based on the Haitian outbreak strain which was found to rapidly protect infant rabbits against lethal cholera-like illness within one day of administration.

Materials and Methods

The following materials and methods were used in this Example.

Study Design

The aim of this study was to design a new live attenuated cholera vaccine candidate, assess the strain's capacity to safely colonize the intestine, determine whether the strain could protect animals from cholera-like illness shortly after its administration, and quantify the potential impact of observed protection parameters on the incidence of cholera infection during an epidemic. The vaccine candidate was derived, from an isolate of the globally predominant *V. cholerae* strain, via sequential allelic exchange steps (see Genetic manipulations), and mutations were verified by whole genome sequencing (see Whole genome sequencing). Studies of intestinal colonization and cholera-like illness were conducted, in compliance with federal and institutional guidelines regarding the use of animals in research, using the infant rabbit model of infection (see Infant rabbit infection studies). 1-2 day old animals were allocated to treatment groups randomly, and within-litter (i.e., co-housed and age-matched) controls were used to minimize the impacts of litter-to-litter variation. For studies of disease progression, assessors were unaware of the treatment administered to each group, and animals found dead within 10 hours of challenge were excluded due to physical trauma consistent with maternal rejection. Transposon-insertion sequencing studies were conducted using the ARTIST pipeline, which models and compensates for experimental noise and offers recommendations for the imposition of effect size thresholds (see Transposon-insertion sequencing analysis). Lastly, modeling incorporating a variable time to vaccine protection into a set of previously published parameters for disease transmission was performed (see Modeling of cholera outbreaks).

Statistical Analysis

Comparisons of two samples were performed using two-sided testing ($\alpha=0.05$) for a t test (fluid accumulation ratios), a Mann-Whitney U test for nonparametric data (bacterial burden), or a log-rank test (survival curve). Comparisons of three samples were performed using the Kruskall-Wallis test followed by Dunn's multiple comparisons test (bacterial burden).

Strains, Media, and Culture Conditions

Table 3 contains a list of strains used in this study. Unless otherwise noted, *V. cholerae* and *E. coli* were grown in lysogeny broth (LB: 10 g/L tryptone, 5 g/L yeast extract, 5 g/L NaCl) with shaking (250 RPM) at 37° C. Recipient strains in phage transduction assays were grown in AKI media (15 g/L peptone, 4 g/L yeast extract, 5 g/L NaCl, autoclaved, then supplemented with freshly made, sterile-filtered 0.3% $NaHCO_3$).

Antibiotics and substrates were used in the following concentrations unless otherwise noted: streptomycin (Sm) (200 μg/mL), carbenicillin (50 μg/mL), chloramphenicol (20 μg/mL), SXT (160 μg/mL sulfamethoxazole, 32 μg/mL trimethoprim), kanamycin (Kn) (50 μg/mL) and 5-Bromo-4-Chloro-3-Indolyl β-D-Galactopyranoside (X-Gal 60 mg/mL).

TABLE 3

Strains and plasmids used in this study

| Strain Identifier | Species | Strain | Plasmid | Resistance | Source |
|---|---|---|---|---|---|
| GB5 | *V. cholerae* | N16961 | | Sm | (10) |
| MKW1161 | *V. cholerae* | Haiti isolate#1-H1 (HaitiWT) | | SXT | (10) |
| MKW1866 | *V. cholerae* | Haiti Δctx | | SXT | This study |
| MKW1867 | *V. cholerae* | Haiti ΔctxΔflaBDE | | SXT | This study |
| MKW1908 | *V. cholerae* | Haiti Δctx ΔflaABCDE | | SXT | This study |
| MKW2156 | *V. cholerae* | Haiti Δctx ΔflaABCDE ΔdfrA ΔfloR ΔstreAB Δsul2 | | | This study |
| MKW2158 | *V. cholerae* | Haiti Δctx ΔflaABCDE ΔdfrA ΔfloR ΔstreAB Δsul2 N900_11550::PhtpG-ctxB | | | This study |
| MKW2159 | *V. cholerae* | Haiti Δctx ΔflaABCDE ΔdfrA ΔfloR ΔstreAB Δsul2 N900_11550::PhtpG-ctxB | | Sm | This study |
| MKW2174 | *V. cholerae* | Haiti Δctx ΔflaABCDE ΔdfrA ΔfloR ΔstreAB Δsul2 N900_11550::PhtpG-ctxB ΔhupB | | Sm | This study |
| GB79 | *V. cholerae* | Haiti Δctx ΔflaABCDE ΔdfrA ΔfloR ΔstreAB Δsul2 N900_11550::PhtpG-ctxB ΔhupB lacZ::cas9-sgRNA ctxA | | Sm | This study |

TABLE 3-continued

Strains and plasmids used in this study

| Strain Identifier | Species | Strain | Plasmid | Resistance | Source |
|---|---|---|---|---|---|
| GB82 | V. cholerae | Haiti Δctx ΔflaABCDE ΔdfrA ΔfloR ΔstreAB Δsul2 N900_11550::PhtpG-ctxB ΔhupB lacZ::cas9-sgRNA_ctxA ΔrecA (HaitiV) | | Sm | This study |
| | E. coli | Dh5alpha λpir | | | |
| | E. coli | MFD λpir | | | (31) |
| | E. coli | | pRK600 | Chlor | |
| MKW1865 | E. coli | MFD λpir | pCVD442 Δctx (HAITI) | Carb | This study |
| MKW1909 | E. coli | MFD λpir | pCVD442 ΔflaAC(Haiti) | Carb | This study |
| YM82 | E. coli | SM10λir | pCVD ΔflaBDE | Carb | (32) |
| MKW2241 | E. coli | MFD λpir | pCVD442 ΔdfrA | Carb | This study |
| MKW2240 | E. coli | MFD λpir | pCVD442 ΔfloR-strAB-sul2 | Carb | This study |
| FD25 | E. coli | MFD λpir | pCVD442 N900_11550::Phtpg-ctxB | Carb | This study |
| MKW2168 | E. coli | MFD λpir | pCVD442 ΔhupB | Carb | This study |
| GB50 | E. coli | Dh5alpha λpir | pJL1 lacZ::cas9-sgRNA_ctxA | Carb | This study |
| MKW2167 | E. coli | MFD λpir | pCVD442 ΔrecA | Carb | This study |
| | E. coli | SM10λir | pCVD442 ΔcqsS | Carb | This study |
| | E. coli | SM10λir | pJL1 | Carb | (34) |
| | E. coli | SM10λir | pSC189 | Carb | (36) |

Genetic Manipulations

All gene deletions and replacements were constructed via homologous recombination using the suicide vector pCVD442, DH5α-λpir and donor strains MFD-λpir (see Ferrieres et al. (2010) J. Bacteria 192(24): 6418-27) or SM10-λpir (Table 3). For all deletions, approximately 500-700 bp homology regions upstream and downstream of the respective ORF were amplified using the primer combinations described below and cloned into XbaI-digested pCVD442 using isothermal assembly.

For derivation of HaitiV from the HaitiWT strain, first, the CTXΦ prophage and surrounding sequences were deleted using primers TDPsCTX1/TDPsCTX2 and TDPsCTX3/TDPsCTX4 to amplify homology regions upstream of the rtx toxin transporter at the 5' end and upstream of a putative dehydrogenase on the 3' end of this region. This results in a deletion of a 42,650 bp fragment that includes the entire CTXΦ prophage, which includes ctxAB, the CTX attachment site, the RS1 and TLC satellite prophages and the MARTX toxin genes rtxABCDE. The knockout was validated via polymerase chain reaction (PCR) using primers TD1027/TDP1028.

Next, the flaBDE operon was deleted as previously described in Millet et al. (2014) PLoS Pathog. 10(10): e1004405. The flaAC operon deletion plasmid was constructed using primers TDP1172/1174 (upstream homology) and TDP1173a/TDP1173 (downstream homology). Subsequently, the SXT ICE-encoded antibiotic resistance loci, dfrA, sul2, strAB, and floR were deleted using primers TDP1193/TDP1194+TDP1195/1196 (dfrA, trimethoprim resistance) and TDP1287/TDP1288+TDP1291/TDP1292 (sulfamethoxazole, streptomycin and chloramphenicol resistance loci). Whole genome sequencing revealed that the second crossover in the allele exchange process occurred not between the homologous regions included in the suicide plasmid, but rather between duplicate sequences flanking the flor/sul region of the chromosome (N900_11210 and N900_11260). An $Sm^R$ mutant of the vaccine precursor strain was isolated by plating on streptomycin (1000 μg/mL), and the $rpsL^{K43R}$ SNV was confirmed by Sanger sequencing.

Figure 7:
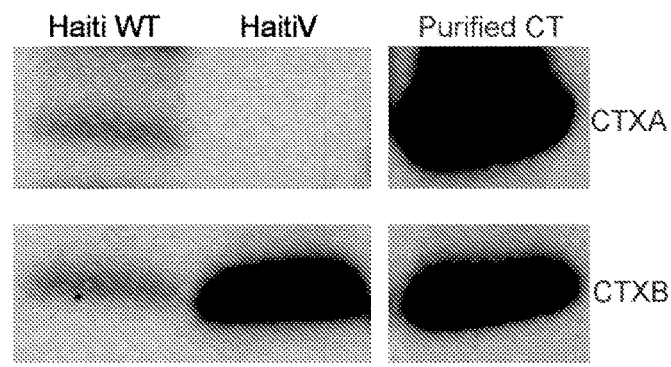
Figure 8A:
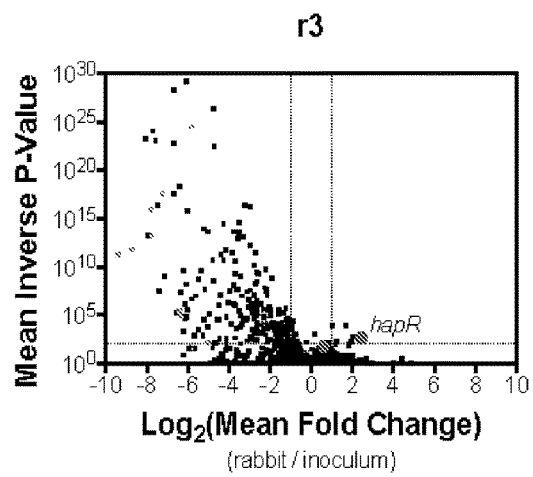
Figure 8B:
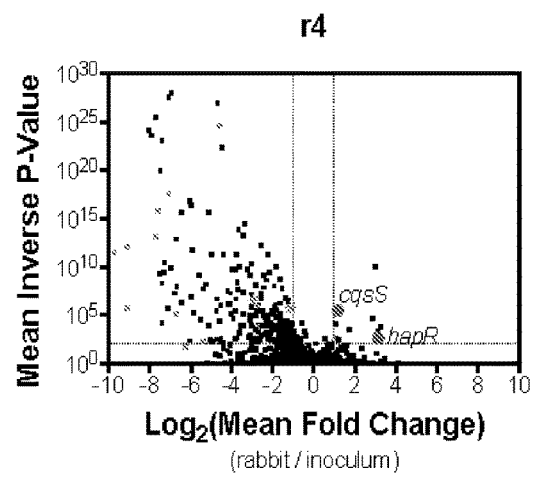
Figure 8C:
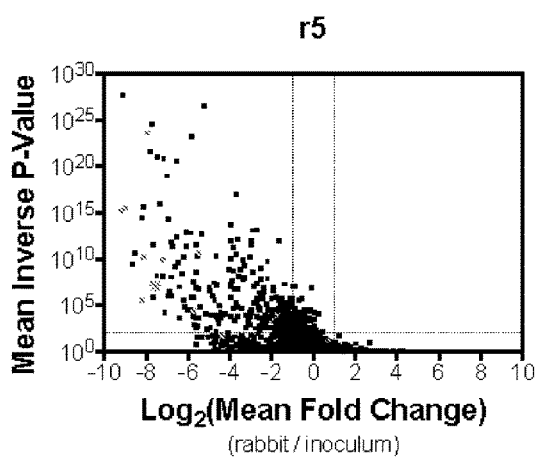
Figure 8D:
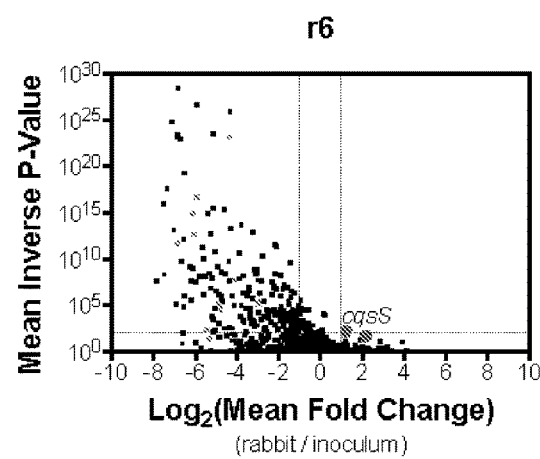
Figure 9A:
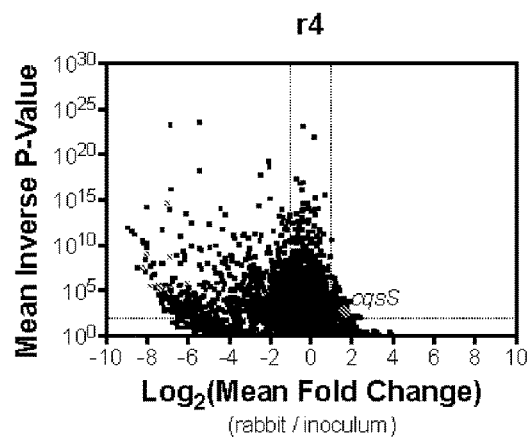
Figure 9B:
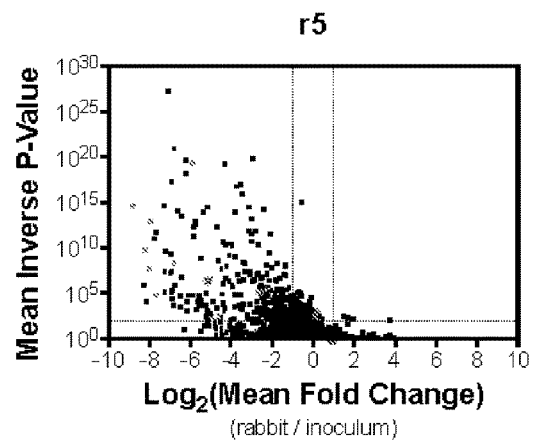
Figure 9C:
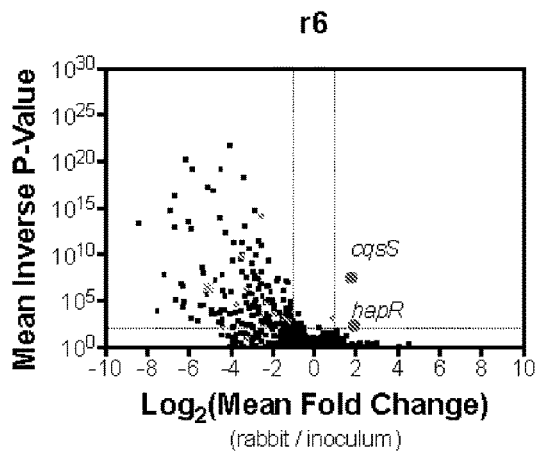
Figure 9D:
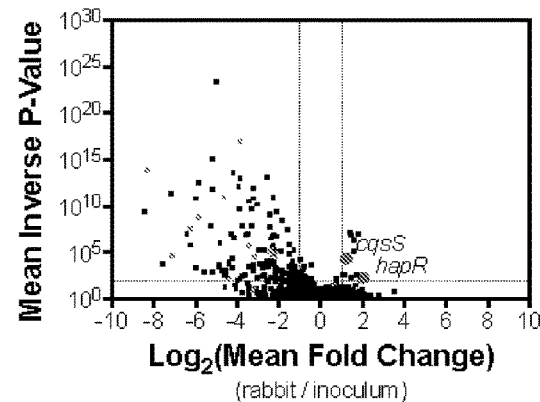

For CtxB overexpression, the htpG promoter was amplified from Peru-15 (see Kenner et al. (1995) J. Infect. Dis. 172(4): 1126-9) using primers FD54/FD103 (adding the strong ribosome binding site AGGAGG (SEQ ID NO: 6)) and ctxB was amplified from HaitiWT, which contains the ctxB7 allele, using primers FD33/FD34. Homologous regions flanking the intergenic region of the validated neutral locus vc0610/N900_11550 (see Abel et al. (2015) Nat. Methods 12(3): 223-6) were amplified with primer pairs FD30/FD31 and FD73/FD74. These fragments were then cloned into pCVD442 in a one-step isothermal assembly reaction. CtxB overexpression was confirmed by Western blot on cell-free supernatants from cultures grown in AKI conditions described above. (Abcam ab123129, anti-cholera toxin; FIG. 7).

Next, the hupB deletion plasmid was constructed using primer pairs Vc-hupB5-F1/Vc-hupB5-R1 and VC-hupB3-F1/Vc-hupB3-R1. The deletion was verified with primers VC-hupB-SF2/Bc-hupB-SR2.

For the cas9-sgRNA module, cas9 was amplified from plasmid DS_SpCas9 (addgene.org/48645/) with primers TDP1747/TDP1748. The sgRNA region was amplified from gBlock 'VC_3x_sgRNA_gBlock' (Table 4) with primers TDP1761/TDP1762. Both fragments were combined and cloned in to the StuI site of pJL1 (Butterton (1995) Infect

*Immun* 63: 2689-96) via isothermal assembly. Sequencing revealed that a recombination event during assembly had removed 2 of 3 sgRNAs, leaving a single guide targeting ctxA. This suicide vector was introduced to the vaccine strain via triparental mating with the helper plasmid pRK600.

TABLE 4

Oligonucleotides used in this study

| Primer number | Primer name | Sequence |
|---|---|---|
| | CTX | |
| TDPsCTX 1 | ctxAfwpCVD | AGGTATATGTGATGGGTTAAAAAGGATCGATCCTTG CTCTCTTGTAGTACCACACTCATAT (SEQ ID NO: 8) |
| TDPsCTX 2 | ctxArev | TCATCATTATTACTCGAGTGCGGCCGCATTACGACGT TTTTGACCGAAGCCG (SEQ ID NO: 9) |
| TDPsCTX 3 | ctxAfw | TAATGCGGCCGCACTCGAGTAATAATGATGAGCTCA ACATTACTCGCCTCAAAAACT (SEQ ID NO: 10) |
| TDPsCTX 4 | ctxArevpCVD | CCGGGAGAGCTCGATATCGCATGCGGTACCTCTAGG CGATCAGAGCCAAGCGTAAG (SEQ ID NO: 11) |
| TDP1027 | ctxAHaitifw | AAGCCGTGGGGAAGTCCTTC (SEQ ID NO: 12) |
| TDP1028 | ctxAHaitirev | CGCTGTCACTGTATAACAATGGAAAGTG (SEQ ID NO: 13) |
| | flaAC | |
| TDP1172 | FlaACfw3rdpCVD | AGGTATATGTGATGGGTTAAAAAGGATCGATCCTAC CTGCCATTACATCGATGATTTGAGC (SEQ ID NO: 14) |
| TDP1173 | FlaAcrev3rdpCVD | CCGGGAGAGCTCGATATCGCATGCGGTACCTCTAGC ATCAAGTTCTGTTCTCGCACAAGC SEQ ID NO: 15) |
| TDP1173a | flaACfw | TAATGCGGCCGCACTCGAGTAATAATGATGATCGCT CATATGGCTTAAGCGCAT (SEQ ID NO: 16) |
| TDP1174 | FlaAcrev3rdLINK | TCATCATTATTACTCGAGTGCGGCCGCATTACATCAA GTTCTGTTCTCGCACAAGC (SEQ ID NO: 17) |
| | dfrA/trim | |
| TDP1193 | trimfwpCVD | AGGTATATGTGATGGGTTAAAAAGGATCGATCCTTT TACAGCCTGACTAGGTTCTTGCTC (SEQ ID NO: 18) |
| TDP1194 | trimrev | TTATCATGCGGCCGCACTCGAGTAATGATAAGCGGA GCTTAACTCAGTGGGG (SEQ ID NO: 19) |
| TDP1195 | trimdwnFW | TTATCATTACTCGAGTGCGGCCGCATGATAAAGTTAT TATGTAGACCTCTCAGTAACATCCG (SEQ ID NO: 20) |
| TDP1196 | trimrevpCVD | CCGGGAGAGCTCGATATCGCATGCGGTACCTCTAGA AGACGATAGCGCAAAGCGC (SEQ ID NO: 21) |
| | sul2/strAB/floR | |
| TDP1287 | florfwpCVD | AGGTATATGTGATGGGTTAAAAAGGATCGATCCTCA ACCGGCTTCGGGCAAC (SEQ ID NO: 22) |
| TDP1288 | florrev | TTATCATTACTCGAGTGCGGCCGCATGATAAATTAA GGAATACCGGGCGACGT (SEQ ID NO: 23) |
| TDP1291 | sulfafw2 | TTATCATTACTCGAGTGCGGCCGCATGATAAGATGC CGAAAATGATGAGCGATTTATTCAT (SEQ ID NO: 24) |
| TDP1292 | sulfarevpCVD2 | CCGGGAGAGCTCGATATCGCATGCGGTACCTCTAGT GAGAATAGTAATTTCGTTTTTGATGGCCAT (SEQ ID NO: 25) |
| | ctxB Overexpression | |
| FD54 | hptGpromfw | ATCTCTTTTGAGTTGTGTCCTAATC (SEQ ID NO: 26) |
| FD103 | re_htpGrev_RBS_ ctxB | AAAACACCAAATTTTAATTTAATCATGGACGTCCTCC TATTCAGCCGTACCCGATTTAGCA (SEQ ID NO: 27) |
| FD33 | newctxBfw | ATGATTAAATTAAAATTTGGTGTTTTTTTTACAGTTT TACTATCTTCAG (SEQ ID NO: 28) |
| FD34 | 2ndctxBrev0610 down | GCAATCCAAGACGCTTGGTGAGAGTTAATTTGCCAT ACTAATTGCGGCAATC (SEQ ID NO: 29) |
| FD30 | new0610downfw | CTCTCACCAAGCGTCTTGGATTGC (SEQ ID NO: 30) |
| FD31 | 0610downrevpCVD | CCGGGAGAGCTCGATATCGCATGCGGTACCTCTAGG GCGTGTTCGCTTCTAGCCTATTGG (SEQ ID NO: 31) |
| FD73 | pCVDfwmid0610 | AGGTATATGTGATGGGTTAAAAAGGATCGATCCTAT GAGCCGTTTTCCAATATCGATACTCAAG (SEQ ID NO: 32) |
| FD74 | vc0610preSTOPrev htpG | GATTAGGACACAACTCAAAAGAGATGGCGAAAGCG AGCACGC (SEQ ID NO: 33) |
| | hupB | |
| | Vc_hupB5-F1 | AGGTATATGTGATGGGTTAAAAAGGATCGATCCTAA GTGCGGGTATCGCCATGTGTAC (SEQ ID NO: 34) |

TABLE 4-continued

Oligonucleotides used in this study

| Primer number | Primer name | Sequence |
|---|---|---|
| | Vc_hupB5-R1 | GCAGAAAAGTGCAAAATCTTCATTCAAATGTGATTC CCCTTTGGTCACCCTT (SEQ ID NO: 35) |
| | Vc_hupB3-F1 | AAGGGTGACCAAAGGGGAATCACATTTGAATGAAG ATTTTGCACTTTTCTGC (SEQ ID NO: 36) |
| | Vc_hupB3-R1 | GGAGAGCTCGATATCGCATGCGGTACCTCTAGCAAT TGACGAACTTGCTCATCACT (SEQ ID NO: 37) |
| | Vc-hupB-SF2 | GTTGCCTTGGAGCAAGACCC (SEQ ID NO: 38) |
| | Vc-hupB-SR2 | CGATGCTGTTCACGCCTTCG (SEQ ID NO: 39) | cas9-sgRNA_ctxA

| Primer number | Primer name | Sequence |
|---|---|---|
| TDP1747 | Cas9fwpJL1 | GTGATGATTGGTACCAGATCTTAATTAAGGTGCAGG AAGCAACGGCCC (SEQ ID NO: 40) |
| TDP1748 | Cas9rev | TCAGTCACCTCCTAGCTGACTCAAATC (SEQ ID NO: 41) |
| TDP1761 | gblockfwCas9 | CACGCATTGATTTGAGTCAGCTAGGAGGTGACTGAA AGAGGAGAAAGGATCTATCGACCAC (SEQ ID NO: 42) |
| TDP1762 | gBlockrevpJL1 | CGGGGATTGGTACCGCGGCCGCTCTAGAGGTGAGG GCTGAACCTCTTTGCA (SEQ ID NO: 43) |
| | VC_3x_sgRNA_gBlock' | AAGAGGAGAAAGGATCTATCGACCACTACCTCGACC CTGATGAAATAAAGCAGTCGTTTTAGAGCTAGAAAT AGCAAGTTAAAATAAGGCTAGTCCGTTATCAACTTG AAAAAGTGGCACCGAGTCGGTGCAAAAAGAGTATT GACTTAAAGTCTAACCTATAGGCATAATTATTTCATC ACTATTTTTGTCGATTATCTTGCTGTTCTAGAGAGCG GGAGCTCAAGTTAGAATAAGGCTAGTCCGTATTCAG TGCGGGAGCACGGCACCGATTCGGTGCAAAAAATTT ATTTGCTTTTTATCCCTTGCGGCGATATAATGTGTGG ATAGAACTAAACAAAGGGAGCATTATAGTTGGAGA GGCATGAGAATGCCAAGTTCCAATAAGGCTAGTCCG TACACACCTAGGAGACTAGGGGCACCGAGTCGGTGC TCGGCAGGCTGAATGCAAAGAGGTTCAGCCTCTCA (SEQ ID NO: 44) | recA

| Primer number | Primer name | Sequence |
|---|---|---|
| | Vc_recA5-F1 | AGGTATATGTGATGGGTTAAAAAGGATCGATCCTGT GACACAATGAAACAGAAGCGAG (SEQ ID NO: 45) |
| | Vc_recA5-R1 | CTTTGCATTCAGCCTGCCGAGTGATAGGTAATTGTGT CGAAATCGG (SEQ ID NO: 46) |
| | Vc_recA3-F1 | CCGATTTCGACACAATTACCTATCACTCGGCAGGCT GAATGCAAAG (SEQ ID NO: 47) |
| | Vc_recA3-R1 | CCGGGAGAGCTCGATATCGCATGCGGTACCTCTAGT CTCTTCCGCAAACTGAATGTGTG (SEQ ID NO: 48) |
| | Vc-recA-SF2 | TGAGCATCTCGCAGCAGATC (SEQ ID NO: 49) |
| | Vc-recA-SR2 | GTTGTAAGGCACTTTGTCGGC (SEQ ID NO: 50) |

Finally, a recA deletion plasmid was constructed using primer pairs Vc-recA5-F1/Vc-recA5-R1 and Vc-recA3-F1/Vc-recA3-R1; the deletion was verified with primers Vc-recA-SF2/Vc-recA-SR2.

Whole Genome Sequencing

Genomic DNA from HaitiWT and HaitiV was prepared using the Nextera XT library preparation kit (ILLUMINA) and sequenced on a MiSeq (Reagent kit v2, 2×250). The genomic sequence of the bacterial chromosomes of HaitiV are provided herein as SEQ ID NOs: 7 and 51. The HaitiV strain was deposited with the American Type Culture Collection (ATCC), located at 10801 University Boulevard, Manassas, Va. 20110, USA on Jun. 22, 2018 under the terms of the Budapest Treaty and assigned ATCC Patent Deposit Designation PTA-125138. Each sample was mapped to its putative genome and variants identified using GATK3.6.

CTXΦ Transduction Assay

Supernatant from *Vibrio cholerae* O395 strains harboring CTXΦ-IGKn (a phage whose genome includes ctxA (see, e.g., Lazar and Walder (1998) *Infect. Immun.* 66: 394-7) or CTX-KnΦ (a phage whose genome lacks ctxA (see, e.g., Waldor and Mekalanos (1996) *Science* 272(5270): 1910-4) (grown at 30° C. in LB to an $OD_{600}$ of 1.0) was concentrated (approximately 50-fold; Ultracel-100K centrifugal filter, MILLIPORE) and filtered (0.22 μm filter, MILLIPORE) to get a cell-free phage supernatant. In order to induce expression of TCP (the phage receptor) in the strains being assayed for CTXΦ susceptibility, overnight LB cultures were back-diluted 1:100 into 10 mL AKI in 16×150 mm glass culture tubes and incubated without shaking for 4 hours at 37° C. All but 1 mL of the culture was then discarded, and the culture was moved to a shaker (250 rpm) for aerobic culture at 37° C. for an additional 2 hours. Recipient cultures were washed once by centrifugation, mixed 2:1 with phage supernatant, and incubated at room temperature for 20 minutes. Serial dilutions were then plated on LB and LB+Kanamycin (100 μg/mL) agar plates, and transduction efficiency was calculated as $(CFU/mL)_{Kan100}/(CFU/mL)_{LB}$.

Generation of HaitiWT-Tn Library

*E. coli* SM10λpir bearing the pir-dependent Himar transposon vector pSC189 (Chiang and Rubin (2002) *Gene* 296(1-2): 179-85) were conjugated with recipient HaitiWT to generate a transposon-insertion library. Overnight cultures of each strain were grown aerobically at 37° C. and then diluted 1:100 in media at 37° C. After 4 hours of outgrowth, 4 mL of each culture was pelleted and washed once with LB. Cultures were then mixed in a 1:1 ratio, pelleted and re-suspended in 800 µL LB. 50 µL of the mix was spotted onto 0.45 µm filters on LB agar plates for a total of 16 conjugation reactions. Reactions were incubated at 37° C. for 4 hours, after which filters were vortexed in LB (1 mL/filter) to re-suspend attached bacteria. Suspensions were plated onto 245 mm² LB+Sm/Kan agar plates to select for $V.$ $cholerae$ trans-conjugants (2 mL suspension/plate). Plates were incubated at 30° C. overnight to enumerate bacterial colonies. The library consisted of ~300,000 colonies and was scraped into LB+25% glycerol. The $OD_{600}$ was adjusted to approximately 10 and aliquots were stored at −80° C. for downstream use.

Infant Rabbit Infection Studies

Infant rabbit studies were conducted according to protocols approved by the Brigham and Women's Hospital Committee on Animals (Institutional Animal Care and Use Committee protocol number 2016N000334, Animal Welfare Assurance of Compliance number A4752-01) and in accordance with the recommendations in the Guide for the Care and Use of Laboratory Animals of the National Institutes of Health and the Animal Welfare Act of the United States Department of Agriculture.

To prepare bacteria for inoculation, overnight cultures were diluted 1:100 in 100 mL LB and cultured with aeration at 37° C. until late-log phase ($OD_{600}$ 0.5 to 0.9). Approximately $2 \times 10^{10}$ CFU were pelleted by centrifugation at 6,000 rpm, the supernatant was removed, and cell pellets were re-suspended in 10 mL of 2.5% sodium bicarbonate solution (2.5 g in 100 mL water; pH 9.0) to a final cell density of approximately $2 \times 10^9$ CFU/mL. For co-infection studies, approximately $1 \times 10^{10}$ CFU were pelleted by centrifugation at 6,000 rpm, the supernatant was removed, cell pellets were re-suspended in 5 mL 2.5% sodium bicarbonate solution, and the resulting suspensions were combined to yield a 1:1 mixture at a cell density of approximately $2 \times 10^9$ CFU/mL. For studies using the HaitiWT transposon library, a 1 mL frozen stock of the library ($OD_{600}$=10) was transferred to 100 mL LB to an initial $OD_{600}$ of 0.1. The library was then cultured with aeration at 37° C. to $OD_{600}$ 0.8 (approximately 2 hours) and approximately $2 \times 10^9$ CFU/mL cell suspension in 2.5% sodium bicarbonate solution was prepared as described above. Preparation of formalin-killed vaccine required the following additional steps: cell pellets were re-suspended in 8 mL of 10% formalin, the formalin suspension was centrifuged at 6,000 rpm, the supernatant was removed, cells were re-suspended in 5 volumes of 1× phosphate buffered saline (40 mL 1×PBS) to wash away excess formalin, the PBS suspension was centrifuged at 6,000 rpm, the supernatant was removed, and cells were re-suspended in 10 mL of 2.5% sodium bicarbonate solution. This procedure eliminated all viable $V.$ $cholerae$. For all experiments, the final cell suspension was serially diluted in 1×PBS and plated in triplicate on LB+Sm/X-Gal, and incubated at 30° C. overnight to enumerate the precise dose. For co-infection studies, the disruption of lacZ in HaitiV enabled enumeration of HaitiWT and HaitiV CFU, blue and white colonies, respectively. For studies using the HaitiWT transposon library, approximately $2 \times 10^{10}$ CFU of the library inoculum were plated on LB+Sm200/Kan50 and incubated at 30° C. overnight to generate a representative sample of the library inoculum used for subsequent statistical comparisons.

Figure 4A:
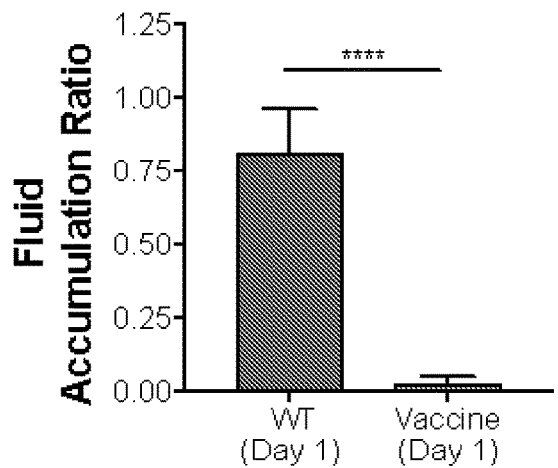

Infant rabbit infections were performed as previously described (Ritchie et al. (2010) $MBio$. 1(1): e00047-10) with minor modifications detailed below. All experiments were conducted using 1-4 day old New Zealand White Rabbits, and animals were co-housed with littermates and a lactating dam for the duration of all studies, which varied in length based on the phenotypes assessed. Animals were obtained from either Pine Acre Rabbitry (Norton, Mass., USA) or Charles River Canada, and phenotypes were consistent across animals from both vendors. Animal studies were always conducted using within-litter controls to minimize the impacts of litter-to-litter variation. Initial studies of HaitiWT and HaitiV colonization (FIG. 4A-C) were conducted following intraperitoneal injection of ranitidine-hydrochloride (2 µg/g body weight) to reduce stomach acidity, however, this treatment was omitted from all subsequent studies because it had no discernible impact on HaitiWT or HaitiV colonization. Animals were oro-gastrically inoculated with approximately $10^9$ CFU (500 µL of a $2 \times 10^9$ CFU/mL bacterial suspension) using a size 5 French catheter (Arrow International, Reading, Pa., USA). One-day-old animals were used for single-inoculation and co-inoculation studies. These animals, were typically euthanized approximately 18 hours post-inoculation; however, longitudinal studies of HaitiV colonization were conducted by inoculating 1 day old animals and monitoring their condition through approximately 90 hours post-inoculation. For sequential inoculation studies, 1 day old animals were inoculated with one of 3 treatments: "mock"—500 µL 2.5% sodium bicarbonate solution, "killed vaccine"—500 µL of a $2 \times 10^9$ CFU/mL suspension of formalin-killed HaitiV, or "live vaccine"—500 µL of a $2 \times 10^9$ CFU/mL suspension of HaitiV. 24 hours later, the same animals were inoculated with approximately $10^9$ CFU (500 µL of a $2 \times 10^9$ CFU/mL suspension of the challenge strain: HaitiWT: FIGS. 5A, 5B, 6A-C; N16961: FIG. 5C; or HaitiTn: FIGS. 5D and 5F). For sequential inoculation studies that report bacterial burden, animals were euthanized approximately 18 hours after challenge, with the exception of FIG. 6C.

At necropsy, the entire intestinal tract was removed, cecal fluid was extracted using a 26½ gauge needle and transferred to a pre-weighed Eppendorf tube. 2-3 cm sections of the distal small intestine, along with the entire cecum, were placed in pre-weighed homogenization tubes containing 1 mL sterile PBS and two 3.2 mm stainless steel beads (BioSpec Products Inc., Bartlesville, Okla., USA) and all filled tubes were weighed. The mass of fluid recovered from the cecum was divided by the mass of the cecum to obtain a fluid accumulation ratio (FAR). The tubes containing tissue were homogenized for 2 minutes on a mini-bead-beater-16 (BioSpec Products Inc., Bartlesville, Okla., USA), serially diluted in 1×PBS, and plated. Plates were incubated at 30° C. overnight and the number of observed colonies was divided by the appropriate dilution ratio and the mass of the corresponding tissue/fluid sample to yield a measure of CFU/g tissue. Homogenates were plated on LB+Sm200/X-Gal60 to enumerate total burden (i.e., HaitiWT+HaitiV) and on LB+SXT to enumerate HaitiWT burden alone. For co-inoculation or sequential inoculation studies, the absence of a HaitiV-specific selectable marker prevented the enumeration of HaitiV CFU unless the burden of HaitiV was comparable to HaitiWT (i.e., within 100-fold). Similarly, for studies utilizing the N16961 WT strain, which is sensitive to SXT, the number of blue colonies on LB+Sm200/X-Gal60 was used to enumerate WT burden. For co-inoculation studies, a competitive index was calculated as:

$$\text{Competitive Index} = \frac{HaitiV\ CFU \div HaitiWT\ CFU_{distal\ small\ intestine}}{(HaitiV\ CFU \div HaitiWT\ CFU)_{inoculum}}$$

For studies using the HaitiWT transposon library, the terminal 10 cm of the distal small intestine were obtained at necropsy, weighed, and homogenized as described above. The homogenate was serially diluted in 1×PBS and plated on LB+Sm200/X-Gal60 to enumerate total burden and LB+Sm200/Kan50 to enumerate the burden of HaitiTn. The remaining 900 µL of undiluted tissue homogenate were plated on LB+Sm200/Kan50 to recover representative samples of the in vivo passaged HaitiTn library that were used for subsequent analyses of sites of transposon insertion.

Colonization data were not reported for animals that reached a moribund state of disease in studies of disease progression, because the interval between inoculation and euthanasia, which varies substantially in these studies, is likely to impact bacterial burden. Instead, animals were euthanized upon assessment of moribund status characterized by a combination of visible diarrhea (staining of the ventral surface), dehydration (skin tenting), weight loss, lethargy (minimal movement), and decreased body temperature (cold to the touch). These assessments were carried out in a blinded fashion as to whether animals received killed vaccine or live vaccine. One animal progressed to moribund status without developing visible diarrhea, explaining the differences in sample sizes between FIGS. 6A and 6B).

Transposon-Insertion Sequencing Analysis

The transposon-insertion libraries were characterized by massively parallel sequencing; sequence data were processed and mapped to the *V. cholerae* H1 genome (see, e.g., Bashir et al. (2012) *Nat. Biotechnol.* 30(7): 701-7) as previously described (see Pritchard et al. (2014) *PLoS Genet.* 10(11): e1004782). Higher complexity libraries (>30,000 unique genotypes) were compared to the input libraries using the ARTIST pipeline. Data were corrected for origin proximity using a LOESS correction of 100,000 bp windows. The inoculum data sets were independently normalized relative to intestinal data sets using Con-ARTIST's multinomial distribution-based random samplings (n=100). A modified version of Con-ARTIST's Mann-Whitney U function was used to compare the intestinal data sets to their 100 simulated control data sets. Thresholds of mean informative sites>5|Log$_2$(mean fold change)|>1, mean inverse P-value>100 were imposed to identify loci for which corresponding insertion mutants are significantly enriched or depleted in the intestinal data sets relative to the inoculum.

Modeling of Cholera Outbreaks

Our model, adapted from a previous study (Azman (2015) *PLoS Med.* 12: e1001867), is depicted schematically in FIG. 10A. Parameters for disease transmission have been previously published (FIG. 10B). The vaccine rollout was modeled as proceeding at a constant number of doses per day over the duration of the campaign (7 days in FIGS. 6D, 11B; varied in FIG. 11A) until 70% of the total population was vaccinated. The campaign was triggered when the number of symptomatic cases (estimated as 25% of total infections in a previously-susceptible population; see Jackson et al. (2013) *Am. J. Trop. Med. Hyg.* 89: 654-64) exceeded a threshold (1,000 people in FIG. 6D, 11A; varied in FIG. 11B). The transmission rate (β) used for simulations was calculated assuming a basic reproductive (R$_0$) number in the range of 1 to 5, consistent with previous cholera outbreaks, with R$_0$=β/γ. Consistent with previous modeling studies (Azman et al. (2013) *J. Infect.* 66: 432-8), the average duration of infectiousness (1/γ) estimated in a household transmission study was assumed (Weil et al. (2009) *Clin. Infect. Dis.* 49: 1473-9). To compare the impact of using a fast vaccine, such as HaitiV, over a slower-acting alternative with equal efficacy against infection, an average time to onset of protection of 1 day versus 10 days (1/τ) after receipt of a single dose was assumed. A "leaky" mode of vaccine action reducing the rate of acquisition by 70% (θ) was modeled. Ordinary differential equations were solved in MATLAB R2016b (Mathworks, Natick, Mass.) using the ode45 function, with initial conditions of a single exposed individual in an otherwise susceptible population. For this model, the system of differential equation is:

$$\lambda = \beta(I_U + I_V + I_P)/N$$

$$\frac{dS_U}{dt} = -\lambda S_U - \rho(t)S_U/N_U$$

$$\frac{dE_U}{dt} = \lambda S_U - \sigma E_U - \rho(t)E_U/N_U$$

$$\frac{dI_U}{dt} = \sigma E_U - \gamma I_U - \rho(t)I_U/N_U$$

$$\frac{dR_U}{dt} = \gamma I_U - \rho(t)R_U/N_U$$

$$\frac{dS_V}{dt} = -\lambda S_V + \rho(t)S_U/N_U - \tau S_V$$

$$\frac{dE_V}{dt} = \lambda S_V - \sigma E_V + \rho(t)E_U/N_U - \tau E_V$$

$$\frac{dI_V}{dt} = \sigma E_V - \gamma I_V + \rho(t)I_U/N_U - \tau I_V$$

$$\frac{dR_V}{dt} = \gamma I_V + \rho(t)R_U/N_U - \tau R_V$$

$$\frac{dS_P}{dt} = -\lambda(1-\theta)S_P + \tau S_V$$

$$\frac{dE_P}{dt} = \lambda(1-\theta)S_P - \sigma E_P + \tau E_V$$

$$\frac{dI_P}{dt} = \sigma E_P - \gamma I_P + \tau E_V$$

$$\frac{dR_P}{dt} = \gamma I_P + \tau R_V$$

Results

Generation of the Genetically Engineered *Vibrio cholerae* Bacterial Strain HaitiV for Use as a Live Attenuated Vaccine Nine different modifications were generated to derive the new vaccine, HaitiV (Table 5), and whole genome sequencing was used to confirm that the mutations were present. Mutations were engineered to ensure biosafety, to a degree unprecedented among cholera vaccines, while maintaining HaitiV's capacity for intestinal colonization so that, like wild type *V. cholerae* and some previously tested live vaccine candidates (Cohen et al. (2002) *Infect. Immun.* 70: 1965-70; and Chen et al. (2016) *Clin. Infect. Dis.* 62(11): 1329-35), it would likely impart long-term immunity after a single oral dose. To ensure the safety of HaitiV, we removed the bacteriophage (CTXΦ) encoding cholera toxin (CT) (Waldor and Mekalanos (1996) *Science* 272(5270): 1910-4) (FIG. 1), the pathogen's principal virulence factor, and provided stringent impediments to toxigenic reversion. The boundaries of the CTXΦ deletion result in the removal of a sequence necessary for its chromosomal integration, as well as the gene encoding the multifunctional MARTX toxin, rtxA (see Fullner et al. (2002) *J. Exp. Med.* 195(11): 1455-

Figure 2:
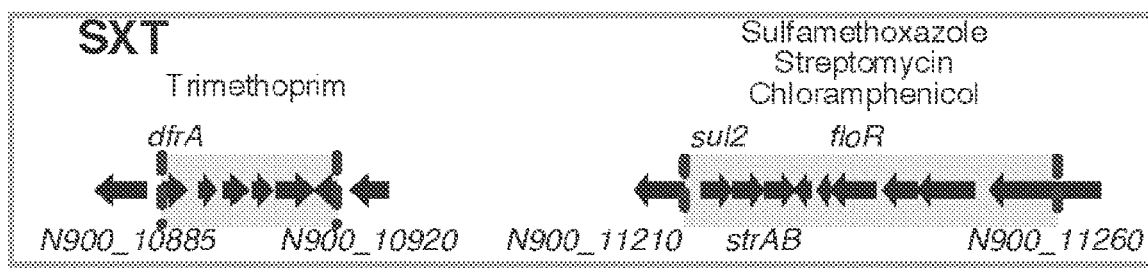
Figure 3A:
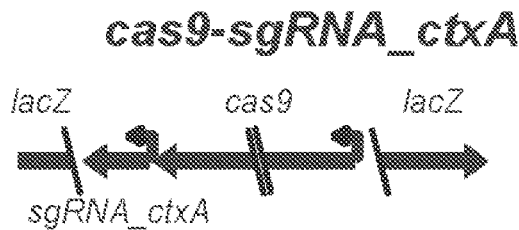
Figure 3B:
Figure 3C:
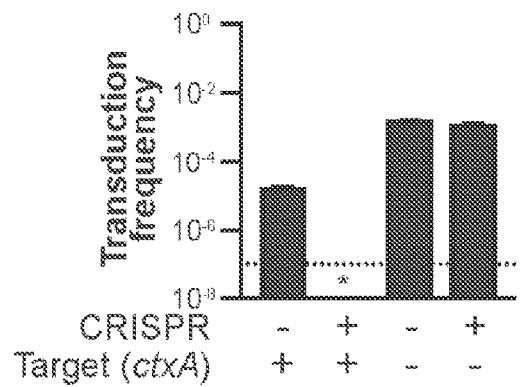
Figure 4B:
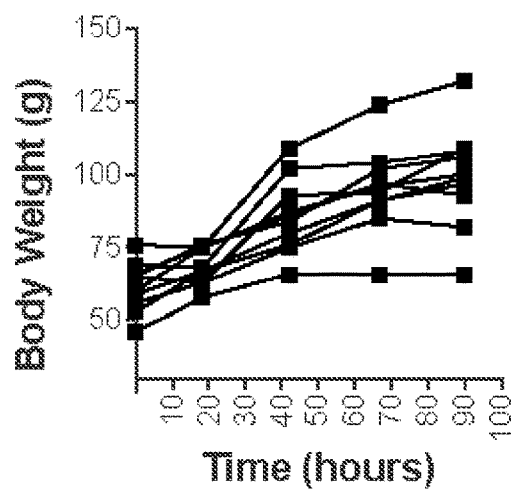

62). Additionally, HaitiV lacks hupB, a gene necessary for episomal maintenance of CTXΦ (see Martinez et al. (2015) *PLoS Genet.* 11(5): e1005256). HaitiV also encodes a CRISPR/Cas9 system specifically targeting the toxin gene ctxA. CTXΦ bearing intact ctxA was unable to infect the vaccine bearing this system, whereas a CTXΦ variant lacking ctxA showed no such barrier to infection (FIGS. 3A-3C). Additional vaccine engineering included steps to 1) reduce potential vaccine reactogenicity by deleting the 5 flagellins of *V. cholera* (see Rui et al. (2010) *Proc. Natl. Acad. Sci. U.S.A.* 107(9): 4359-64); 2) eliminate the vaccine's capacity to transfer genes, conferring resistance to antibiotics, that lie within the SXT Integrative Conjugative Element (ICE) (FIG. 2); 3) allow the vaccine to produce the non-toxic B subunit of CT (FIG. 7), which may elicit protection against diarrheal disease caused by enterotoxigenic *E. coli* as well as *V. cholerae* (Kauffman et al. (2016) *MBio.* 7(6): e 02021-16); and 4) minimize potential gene acquisition by deleting recA, thereby markedly reducing the strain's capacity for DNA recombination. The genetic alterations in the HaitiV live attenuated cholera vaccine are summarized in Table 5.

lated with HaitiV continued to gain weight up to 90HPI, providing further indication that HaitiV inoculation is not detrimental to overall health or development of the animals (FIG. 4B).

Figure 4C:
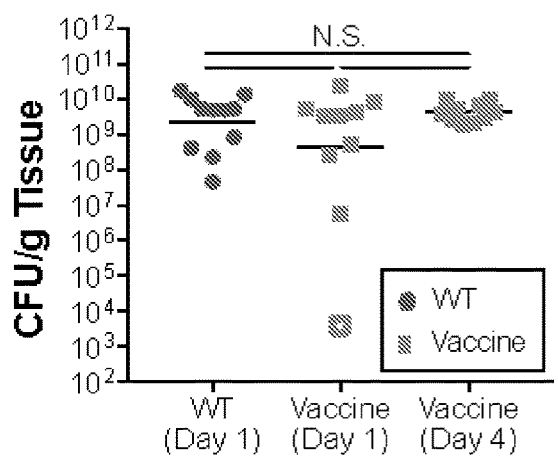

The distinct responses to HaitiWT or HaitiV inoculation were not associated with differences between intestinal colonization by the two strains. At 18HPI, there was no significant difference in *V. cholerae* colonization of the distal small intestine between littermates inoculated with HaitiV or HaitiWT (FIG. 4C). HaitiV burden showed no reduction by 90HPI (FIG. 4C), indicating that prolonged intestinal colonization by HaitiV does not cause disease. Although levels of intestinal colonization by HaitiV and HaitiWT were not statistically distinguishable in single inoculation experiments, when animals were co-inoculated with a 1:1 mixture of HaitiWT and HaitiV, the wild type strain outcompeted the vaccine strain (FIG. 4D). HaitiV's colonization is comparable to that of strains closely related to Peru-15 (see Rui et al. (2010)), an earlier live cholera vaccine candidate that was found to be safe and to confer protective immunity with a single dose (see Cohen et al. (2002)); thus, a single dose of HaitiV is expected to prompt protective adaptive immunity.

TABLE 5

Genetic alterations present in the exemplary HaitiV live attenuated cholera vaccine

| Mutation | Rationale |
| --- | --- |
| ΔCTXΦ | Attenuates by removing the genes encoding cholera toxin and the multifunctional toxin MARTX (see Fullner et al. (2002) *J. Exp. Med.* 195(11): 1455-62); protects against toxigenic reversion by preventing chromosomal integration of CTXΦ (see Waldor and Mekalanos (1996) *Science* 272(5270): 1910-4). |
| ΔflaBDE/ΔflaAC | Attenuates and reduces potential reactogenicity (see Rui et al. (2010) *Proc. Natl. Acad. Sci. U.S.A.* 107(9): 4359-64). |
| ΔfloR-strAB-sul2/ΔdfrA | Prevents the dispersal of antibiotic resistance genes. |
| N900_115550::Phtpg-ctxB | Constitutive expression of CtxB (FIG. 7) promotes anti-CtxB immune response that may protect against diarrheal disease caused by *V. cholerae* and enterotoxigenic *E. coli* (ETEC) (see Kauffman et al. (2016) *MBio.* 7(6): e 02021-16). |
| ΔhupB | Protects from toxigenic reversion by inactivating the HU complex, which is necessary for extrachromosomal replication of CTXΦ (see Martinez et al. (2015) *PLoS Genet.* 11(5): e1005256). |
| lacZ::cas9-sgRNA_ctxA | Endonuclease targeting of ctxA prevents toxigenic reversion. |
| ΔrecA | Prevents homologous recombination-dependent gene acquisition. |

HaitiV is an Attenuated *V. cholerae* Bacterial Strain

Comparative studies of oro-gastrically inoculated HaitiV as compared to the wild type *V. cholerae* isolate from which it was derived (referred to herein as HaitiWT) were performed in infant rabbits, a small animal model that recapitulates many aspects of human cholera, including rapid mortality (see Ritchie et al. (2010) *MBio.* 1(1): e00047-10). All animals inoculated with HaitiWT progressed to a moribund state by 18 hours post-inoculation (18HPI). Upon necropsy, the ceca of these animals were filled with fluid (FIG. 4A) which has been previously found to resemble ctxAB-dependent choleric diarrhea (see Ritchie et al. (2010)). In marked contrast, minimal or no fluid accumulated by 18HPI in the ceca of littermates inoculated with HaitiV (FIG. 4A). Animals inoculated with HaitiV did not exhibit cholera-like illness during observation periods extending to 90HPI, although in rare cases animals showed mild and self-limited non-choleric diarrhea. Animals inocu- Inoculation with HaitiV Induces a Protective Response Against the Virulent *V. cholerae* Bacterial Strain HaitiWT Given HaitiV's robust and prolonged occupancy of the intestine, experiments were performed to determine whether HaitiV-colonized animals might exhibit resistance to colonization by HaitiWT even prior to the development of an adaptive immune response, for example due to alteration of the pathogen's intestinal niche. Animals were inoculated either with HaitiV (live vaccine), formalin-killed HaitiV (killed vaccine), or a buffer control (mock), and then challenged 24 hours later with a lethal dose of HaitiWT. Animals in the buffer and formalin groups developed severe cholera-like illness following HaitiWT challenge, and intestinal burdens of HaitiWT in these animals resembled those without pretreatment (FIGS. 5A, 5B, and 4C). Conversely, no animals that received live vaccine exhibited signs of severe disease within 18 hours of HaitiWT challenge, and lower levels of HaitiWT were recovered from the intestines of animals previously inoculated with live vaccine versus those inoculated with killed vaccine (FIG. 5B). The reduction in HaitiWT burden varied in magnitude across animals previously inoculated with live vaccine, falling below the limit of detection in two animals. The live vaccine's antagonism of HaitiWT colonization (i.e., colonization resistance) appeared to be dependent on prior inoculation with HaitiV; normal burdens of HaitiWT were observed in animals inoculated with the two strains simultaneously rather than sequentially (FIG. 4E versus FIG. 5B).

To assess the specificity of colonization resistance, the vaccine study was repeated, challenging with *V. cholerae* N16961, an early El Tor strain administered to human volunteers in studies of cholera vaccine efficacy (see Chen et al. (2016) *Clin. Infect. Dis.* 62(11): 1329-35). Importantly, the Haitian and N16961 strains were isolated independently and are of distinct serotypes (see Chin et al. (2011) *N. Engl. J. Med.* 364(1): 33-42). Animals inoculated with live HaitiV, but not killed HaitiV, also exhibited colonization resistance against the N16961 WT challenge (FIG. 5C), demonstrating that HaitiV-mediated colonization resistance is neither strain-nor serotype-specific.

Given the low levels of HaitiWT burden in animals inoculated with HaitiV, it was possible that the vaccine's occupancy of the intestine interfered with processes required for colonization by the challenge strain. Therefore, a forward genetic screen to identify mutations that allow HaitiWT to resist or evade vaccine-mediated antagonism was performed. Such mutations could provide insight into the mechanism(s) by which HaitiV mediates colonization resistance, and were predicted to confer a fitness advantage to HaitiWT, specifically in the HaitiV-colonized intestine. Animals were challenged with a pooled HaitiWT transposon insertion library (HaitiTn) in the absence of pretreatment (single inoculation, FIGS. 5D and 5E) or 24 hours post-inoculation with live vaccine (sequential inoculation, FIGS. 5F and 5G). HaitiTn colonization in the absence of pretreatment was indistinguishable from HaitiWT colonization of animals previously inoculated with a mock treatment or killed vaccine (FIG. 5D vs. FIGS. 5A and 5B). Additionally, the range of HaitiTn colonization in vaccine-pretreated animals recapitulated the highly variable HaitiWT burden observed upon sequential inoculation of HaitiV and HaitiWT (FIG. 5F vs. FIG. 5B).

To identify enriched mutants, the transposon junctions from HaitiTn recovered from the distal small intestine were sequences and a genome-wide comparison of mutant abundance in animals subjected to HaitiTn challenge without pretreatment (FIG. 5) or following HaitiV inoculation (FIG. 5G) was performed. To ensure requisite statistical power, the analysis was restricted to animals colonized by sufficiently diverse HaitiTn populations encompassing multiple independent disruptions per gene (rabbits r3-r6 for single inoculation, rabbits r4-r7 for sequential inoculation). Notably, insertions disrupting cqsS and hapR, components of a *Vibrio*-specific quorum sensing (QS) pathway, were enriched in multiple animals, independent of pretreatment (FIGS. 5E and 5G, FIGS. 8A-9D). QS down-regulates expression of virulence and colonization factors at high cell densities (Rutherford and Bassler (2012) *Cold Spring Harb. Perspect. Med.* 2(11): pii: a012427; Zhu et al. (2002) *Proc. Natl. Acad. Sci. U.S.A.* 99: 3129-34; Duan and March (2010) *Proc. Natl. Acad. Sci. U.S.A.* 107: 11260-4; and Hsiao et al. (2014) *Nature* 515: 423-6), and enrichment of cqsS and hapR mutants, which are blind to this inhibition, suggests that QS pathways constrain HaitiWT growth in the intestine. Corresponding enrichment of QS mutants was not identified in similar analyses of closely related *V. cholerae* isolates (Kamp et al. (2013) *PLoS Pathog.* 9: e1003800), suggesting that QS may play a distinct role in the pathogenesis of variant El Tor strains. The genome-wide screen failed to identify any mutants that were consistently and specifically enriched in vaccine-colonized animals, indicative that single loss-of-function mutations are unlikely to enable HaitiWT to resist or evade vaccine-mediated antagonism.

The genetic diversity intrinsic to the HaitiTn library utilized in the experiments described above allowed for an assessment as to whether HaitiV-mediated colonization resistance was associated with changes in the severity of the infection bottleneck that *V. cholerae* encounters in vivo (Abel et al. (2015) *Nat. Methods* 12: 223-6; Abel et al. (2015) *PLoS Pathog.* 11: e1004823). *V. cholerae* recovered from the intestine arise from a founding population of organisms that persist following a stochastic constriction of the bacterial inoculum (Abel et al. (2015) *Nat. Methods* 12: 223-6). The severity of this infection bottleneck can be estimated from the number of unique transposon insertion mutants recovered from the intestine (Chao et al. (2016) *Nat. Rev. Microbiol.* 14: 119-28). A subset of animals previously inoculated with live vaccine were colonized by relatively few unique insertion mutants and showed low HaitiTn burdens (FIG. 5F, rabbits r1-r3), suggesting that HaitiV-mediated colonization resistance is, in some cases, associated with a highly restrictive infection bottleneck. Importantly, there was no overlap in the mutants recovered from low diversity animals, which indicates that the restrictive infection bottlenecks observed in some HaitiV-inoculated animals are stochastic and genotype-independent. Reduced colonization was also observed in animals in which the vaccine did not appear to impose a bottleneck (FIG. 5F, rabbits r4-7). The variable bottlenecks observed in vaccine-colonized animals, along with the inability to identify mutants resistant to vaccine antagonism, highlights the possibility that the mechanism(s) underlying colonization resistance may be complex and/or multi-factorial. However, the lower burdens of HaitiWT and the absence of severe disease following challenge of vaccine-colonized animals suggests that inoculation with HaitiV may be sufficient to protect against cholera-like illness.

HaitiV Induces Protection Against the Virulent *Vibrio cholerae* Strain HaitiWT within 24 Hours of Administration To quantify HaitiV-dependent protection from cholera-like disease, infant rabbits were inoculated with live or killed vaccine, challenged with HaitiWT 24 hours later, and monitored regularly to assess their status. All animals inoculated with killed vaccine developed diarrhea (median onset 15 hours) and progressed to a moribund state within 29 hours of HaitiWT inoculation (median 18.8 hours) (FIG. 6A). In stark contrast, animals inoculated with live vaccine were significantly slower to develop diarrhea (median 28.3 hours; one animal did not develop visible diarrhea) and showed a marked increase in survival time post lethal challenge (median>41.3 hours; FIG. 6A) and in survival post onset of diarrhea (>13 hours versus 5 hours in control animals; FIG. 6B). Additionally, 4 animals inoculated with live vaccine had not reached a moribund state when the study was concluded 40 hours post lethal challenge despite detectable HaitiWT colonization in all animals (FIGS. 6A and 6C). Thus, HaitiV may protect from disease even in the absence of absolute colonization resistance. The rapidity of HaitiV-induced colonization resistance and disease protection, and the observation of these phenotypes in a neonatal model of infection, are not consistent with vaccine-elicited adaptive immune protection. Instead, the data indicate that HaitiV colonizes the intestine and mediates viability-dependent protection against cholera, properties consistent with the definition of a probiotic agent (see Hill et al. (2014) *Nat. Rev. Gastroenetrol. Hepatol.* 11: 506-514).

Figure 11A:
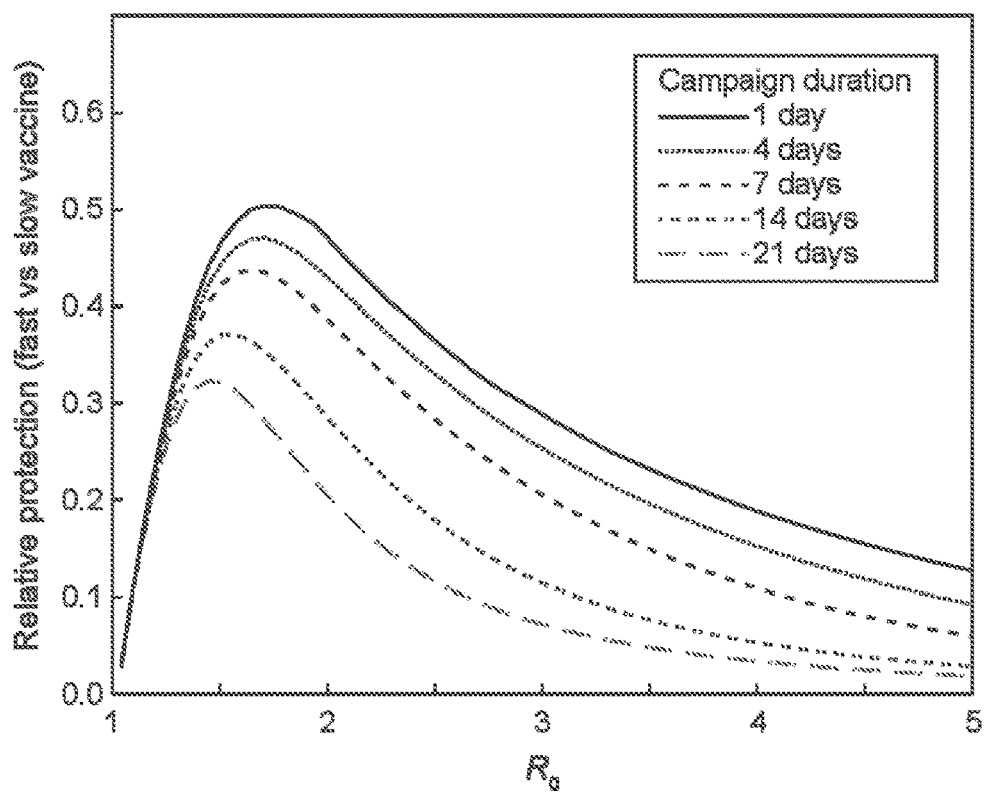
Figure 11B:
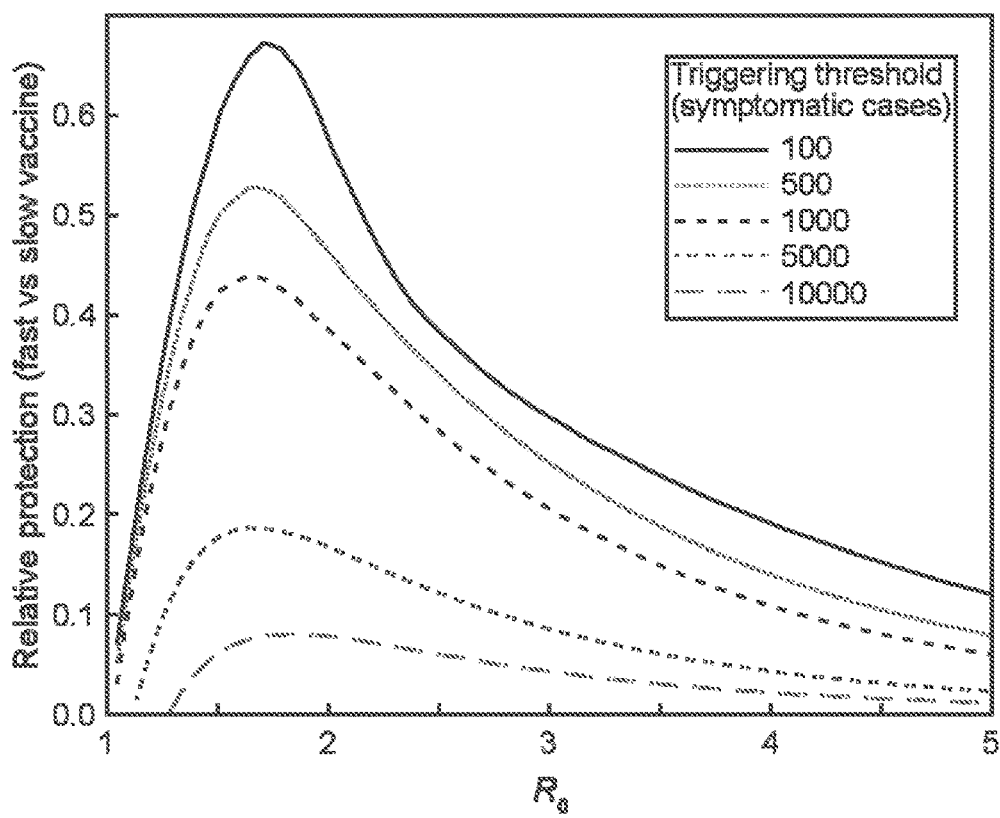
Figure 12A:
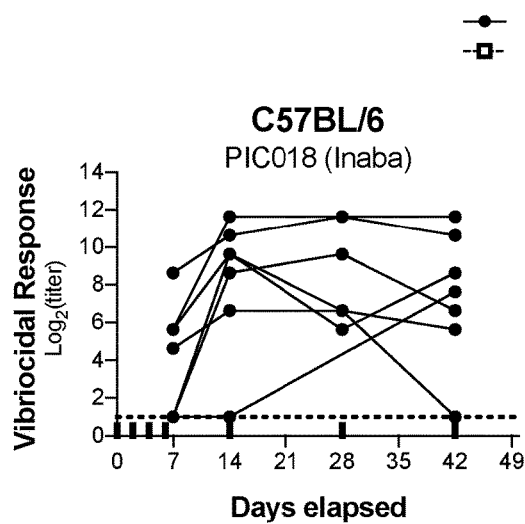
Figure 12B:
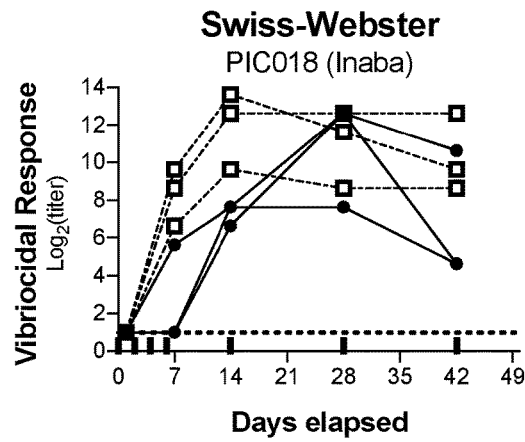
Figure 12C:
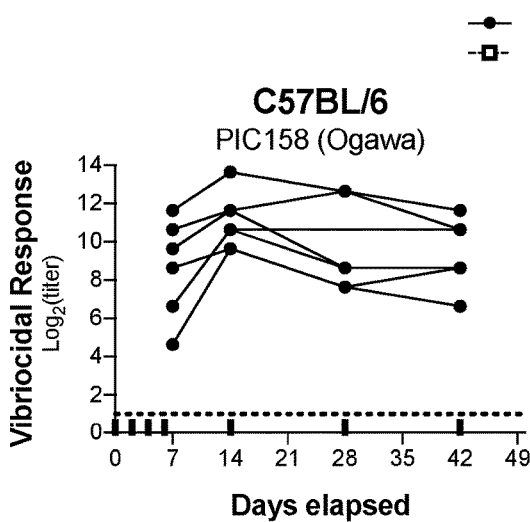
Figure 12D:
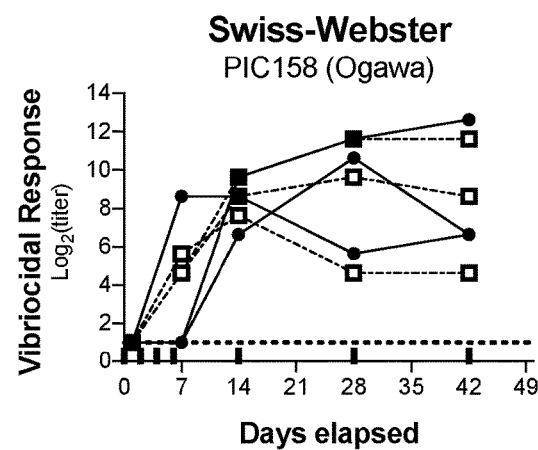
Figure 13A:
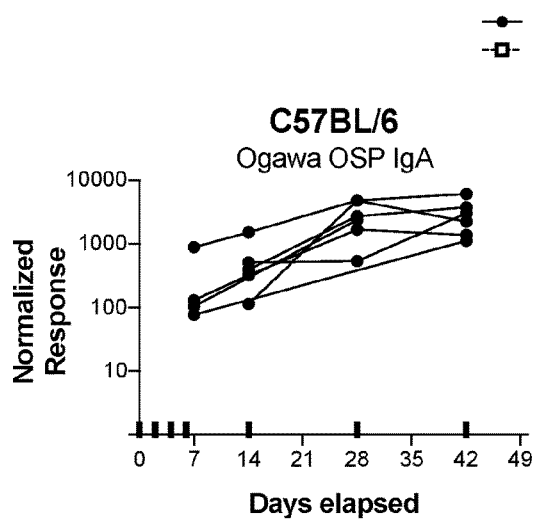
Figure 13B:
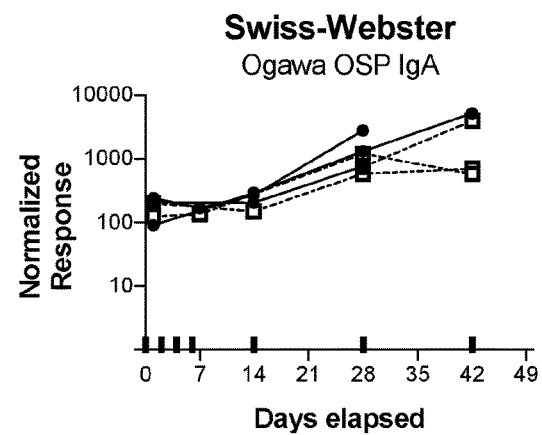
Figure 13C:
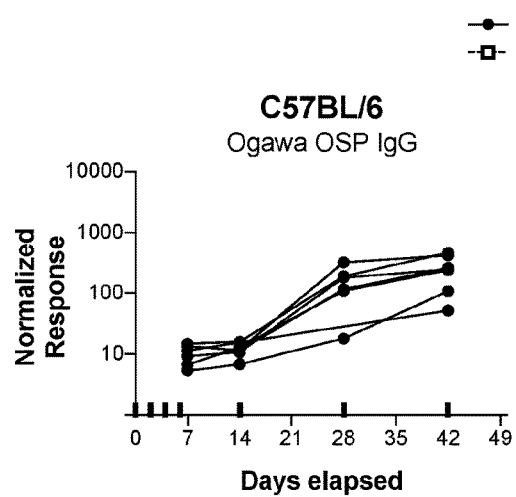
Figure 13D:
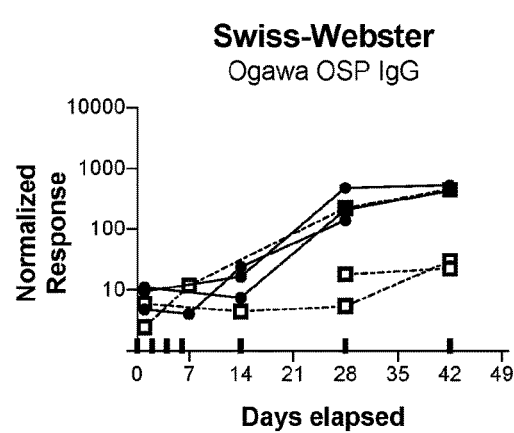
Figure 14A:
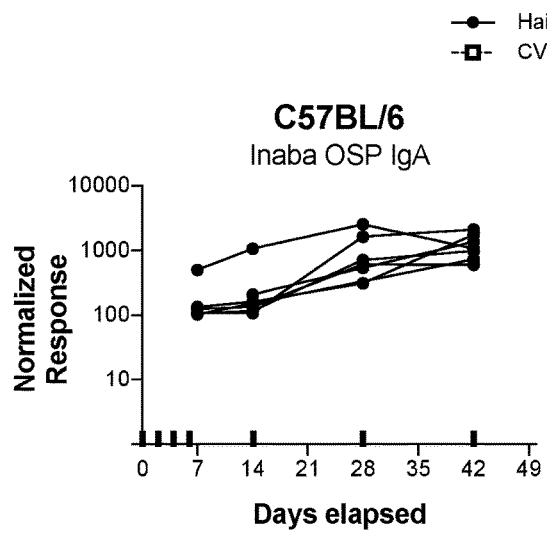
Figure 14B:
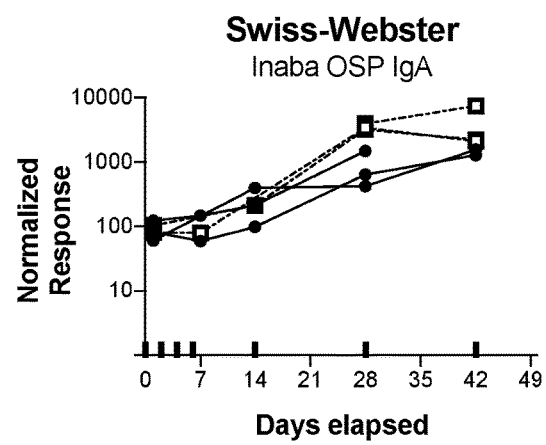
Figure 14C:
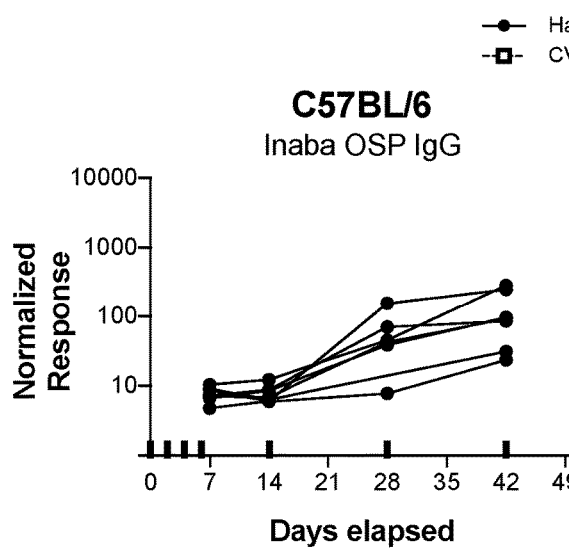
Figure 14D:
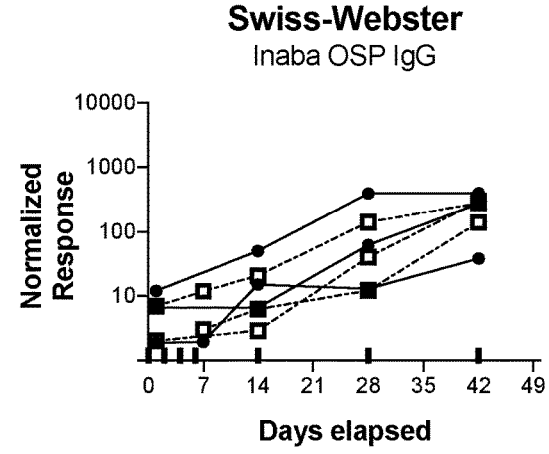

To investigate how HaitiV's rapid protection might impact reactive vaccination campaigns, a previously-published mathematical model of a cholera outbreak in a susceptible population, an epidemic context prioritized for reactive OCV interventions, was modified (Azman (2015) *PLoS Med.* 12: e1001867; Reyburn et al. (2011) *PLoS Negl. Trop. Dis.* 5: e952). Modifications to the mathematical model (FIG. 10A) allowed for the computation of the effects of vaccines that confer equal degrees of protection in 1 day (fast vaccine—based on observations in FIG. 5A-5G, 6A, and 6B) or in 10 days (slow vaccine—when some recipients of killed OCVs manifest vibriocidal titers (Matias et al. (2016) *PLoS Negl. Trop. Dis.* 10: e0004753). Varying different model parameters revealed that maximal benefit of a fast vaccine, relative to a slow vaccine, occurs under transmission dynamics consistent with recent outbreaks (R0: 1.5 to 3) and with rapid vaccine administration (FIGS. 10B, 11A and 11B). These simulations revealed that, compared to a slow vaccine, an equally efficacious fast vaccine could avert an additional 20,000 infections in a population of 100,000 (FIG. 6D) by preventing infections that could be acquired in the window between administration of the slow vaccine and the emergence of protective immunity.

Provided herein is the design and characterization of a new live attenuated cholera vaccine candidate, HaitiV. The studies above indicate that HaitiV is refractory to toxigenic reversion and that it colonizes an animal model of cholera without causing cholera-like disease or other untoward effects. The infant rabbit model is well-suited for the intestinal colonization and disease progression studies reported above. The study is limited by the poorly characterized intestinal microbiota and adaptive immune capacity of rabbit neonates, which restrict further investigation of HaitiV's mechanism(s) of action and immunogenicity in this system. There are no robust animal models to investigate adaptive immunity to cholera; as with previous cholera vaccines, evaluating the adaptive immune response elicited by HaitiV will require human volunteer studies. Encouragingly, HaitiV's colonization was comparable to that of strains closely related to Peru-15 in the same model (Rui et al. (2010) *Proc. Nat'l. Acad. Sci. USA* 107(9): 4359-64), an earlier live cholera vaccine candidate found to be safe in humans and to confer protection with a single dose (Cohen et al. (2002) *Infect. Immun.* 70: 1965-70) even in children under 5 who are not protected by killed OCVs (Qadri (2007) *Vaccine* 25: 231-8. Surprisingly, HaitiV was found to confer protection within 24 hours of administration, an interval that is not consistent with adaptive immunity and unprecedented among existing vaccines. Notably, these effects required use of viable HaitiV; formalin-killed HaitiV did not provide acute protection from disease, suggesting that rapid protection requires a probiotic effect that is unlikely to be elicited by killed OCVs. Human challenge studies are a well-established system for assessing the adaptive immune protection elicited by OCVs (Chen et al. (2016) *Clin. Infect. Dis.* 62(11): 1329-35 and Cohen et al. (2002) *Infect. Immun.* 70: 1965-70). Incorporating additional acute challenges (e.g., within 24 hours post-vaccination) will illuminate the onset and duration of OCV protection, thereby assessing whether HaitiV or other OCVs elicit protection prior to adaptive immune responses, as observed in the infant rabbit model.

Although the mechanisms underlying HaitiV's acute protection are likely complex and require further elucidation, the mathematical modeling described in this study indicates that the public health impacts of HaitiV's rapid protection could be transformative in the context of reactive vaccination during cholera epidemics. Relative to controls, HaitiV-inoculated animals challenged with a lethal dose of HaitiWT survived longer following the onset of diarrhea, displayed lower levels of HaitiWT colonization, and in some cases, were completely protected from cholera. HaitiV-induced delay of disease progression suggests that individuals who are infected with pathogenic *V. cholerae* after being inoculated with HaitiV may have more time to access life-saving treatment following the onset of symptoms. The time that elapses between onset of symptoms and administration of treatment is often the determinant of case fatality rates during cholera outbreaks, because re-hydration therapy is sufficient to prevent death in virtually all symptomatic individuals (Farmer et al. (2011) *PLoS Negl. Trop. Dis.* 5: e1145). Additionally, the colonization resistance mediated by HaitiV, but not formalin-killed HaitiV, suggests that inoculation with HaitiV may reduce shedding of toxigenic *V. cholerae* into the environment, the transmission route that perpetuates outbreaks. Although HaitiV's potential effects on transmission were not incorporated into the modeling studies, a reduction in transmission is likely to potentiate the already dramatic impact that HaitiV could have on outbreak control. Overall, the above studies suggest that probiotic vaccines, mediating rapid protection from disease while eliciting adaptive immunity, could constitute a new class of therapeutics with a transformative impact on outbreak control.

Example 2. HaitiV Induces a Vibriocidal Antibody Response and Anti-OSP Antibodies in Mice HaitiV Induces a Vibriocidal Antibody Response in Mice To determine whether inoculation with HaitiV induces a vibriocidal antibody response, C57BL/6 and Swiss-Webster mice were inoculated with either HaitiV or a spontaneous streptomycin resistant mutant derived from the *V. cholerae* bacterial strain CVD103-HgR, referred to herein as CVD103-HgR* (control). CVD-103HgR (Vaxchora™; PaxVax, Inc., Redwood City, Calif., USA) is currently approved for the prevention of cholera caused by *V. cholerae* O1 in adult travelers. Sera vibriocidal activity was analyzed using an in vitro microdilution assay to assess complement-mediated cell lysis of *V. cholerae* PIC018 (Inaba serotype) or PIC158 (Ogawa serotype). As shown in FIGS. 12A-12D, a robust vibriocidal response was observed in sera collected from mice 7 days after initial inoculation with either HaitiV or CVD103-HgR*.

Anti-OSP IgA and IgG Titers Increase Over Time in Mice Inoculated with HaitiV

To determine whether inoculation with HaitiV induces an antibody response against O-antigen-specific polysaccharide (OSP), C57BL/6 and Swiss-Webster mice were inoculated with either HaitiV or CVD103-HgR* (control), and the abundance of anti-OSP IgA and anti-OSP IgG antibodies against either Ogawa-derived or Inaba-derived OSP was measured using ELISA. As shown in FIGS. 13A-13D and 14A-14D, the abundance of anti-OSP IgG and IgA antibodies increased over time. Mice inoculated with HaitiV exhibited a more pronounced IgG response to Ogawa-derived OSP than mice inoculated with CVD103-HgR*.

Materials and Methods

The following materials and methods were used in this Example.

To generate a streptomycin resistant strain of CVD103-HgR (Vaxchora™; PaxVax, Inc., Redwood City, Calif., USA), the bacterial strain was inoculated into 5 mL of LB broth and cultured with aeration (250 rpm) at 37° C. overnight. 1 mL of the overnight culture was plated on LB agar+streptomycin (1000 µg/mL) and incubated at 37° C.

overnight. Colonies that arose on LB agar+streptomycin (1000 µg/mL) were considered spontaneous streptomycin resistant mutants of CVD103-HgR, hereafter referred to as CVD103-HgR*.

HaitiV immunogenicity studies were conducted using female, germ-free C57BL/6 mice (n=7, Massachusetts Host-Microbiome Center) and female, germ-free Swiss-Webster mice (n=6, Taconic Farms) housed in a BL-2 animal facility for the duration of study. HaitiV or CVD103-HgR* bacteria were resuspended in 2.5% sodium bicarbonate solution (pH 9.0) to a final concentration of $10^{10}$ colony forming units per mL (CFU/mL). Mice were anesthetized via isoflurane inhalation and orally gavaged with 100 µL of the bacterial suspension ($10^9$ CFU per mouse). This procedure was repeated at 2, 4, 6, 14, 28, and 42 days following the initial immunization. Mice were monitored daily for signs of disease and weighed every 4-5 days and prior to each immunization. Fecal pellets were obtained at each weighing, and pellets were homogenized in 1× phosphate buffered saline (PBS) and serial dilutions were plated on LB+streptomycin (200 µg/mL) to enumerate fecal burdens of HaitiV. For the C57BL/6 cohort, blood samples were obtained via tail vein incision at 7, 14, 28, and 42 days post-immunization. For the Swiss-Webster cohort, blood samples were obtained via tail vein incision at 1, 7, 14, 28, and 42 days post-immunization. Blood was allowed to clot at room temperature for 1 hour, centrifuged at 13,000 rpm for 5 minutes, and the supernatant (serum) was collected and stored at −20° C. for subsequent analyses.

Vibriocidal antibody quantification was performed as previously described (Rollenhagen et al. (2009) *Vaccine* 27(36): 4917-22, and Tarique et al. (2012) *Clin. Vaccine Immunol.* 19(4): 594-60, each of which is incorporated herein by reference) via an in vitro microdilution assay of complement-mediated cell lysis of *V. cholerae* PIC018 (Inaba) or PIC158 (Ogawa). Vibriocidal responses are reported as titers (i.e., the dilution of serum) causing a 50% reduction in *V. cholerae* optical density compared to wells with no added serum. Antibody responses to either Inaba or Ogawa O-antigen-specific polysaccharide (OSP) were assessed via enzyme-linked immunosorbent assay (ELISA) as described in Aktar et al. (2016) *Clin. Vaccine Immunol.* 23(5): 427-35, incorporated herein by reference. Data are presented as normalized response, which is the ratio of ELISA signal for the test sample to a standardized pool of sera included on each plate.

REFERENCES

1. Balakrishnan (2017) *Lancet Infect. Dis.* 17: 700-1.
2. Ali et al. (2015) *PLoS Negl. Trop. Dis.* 9: e0003832.
3. Clemens et al. (2017) *Lancet* 390(10101): 1539-49.
4. Qadri et al. (2015) *Lancet* 386: 1362-1371.
5. Luquero (2014) *N. Engl. J. Med.* 370: 2111-2120.
6. Kabir (2014) *Clin. Vaccine Immunol.* 21: 1195-1205.
7. Chen et al. (2016) *Clin. Infect. Dis.* 62: 1329-1335.
8. Qadri et al. (2007) *Vaccine* 25: 231-238.
9. Calain et al. *Vaccine* 22: 2444-2451.
10. Chin et al. (2011) *N. Engl. J. Med.* 364: 33-42.
11. Cohen (2002) *Infect Immun* 70: 1965-1970.
12. Waldor and Mekalanos (1996) *Science* 272: 1910-1914 (1996).
13. Fullner et al. (2002) *J. Exp. Med.* 195: 1455-1462.
14. Martinez et al. (2015) *PLoS Genet.* 11: e1005256.
15. Rui et al. (2010) *Proc. Natl. Acad. Sci. U.S.A.* 107,4359-4364 (2010).
16. Kauffman et al. (2016) *mBio* 7(6): e02021-16.
17. Ritchie et al. (2010) MBio. 1(1): e00047-10.
18. Rutherford and Bassler (2012) *Cold Spring Harb. Perspect. Med.* 2(11): pii: a012427.
19. Zhu et al. (2002) *Proc. Natl. Acad. Sci. U.S.A.* 99: 3129-3134.
20. Duan and March (2010) *Proc. Natl. Acad. Sci. U.S.A.* 107: 11260-11264.
21. Hsiao et al. (2014) *Nature* 515: 423-426.
22. Kamp et al. (2013) *PLoS Pathog.* 9: e1003800.
23. Abel et al. (2015) *Nat. Methods* 12: 12(3): 223-6.
24. Abel et al. (2015) *PLoS Pathog.* 11: e1004823.
25. Chao et al. (2016) *Nat. Rev. Microbial.* 14: 119-128.
26. Azman et al. (2015) *PLoS Med.* 12: e1001867.
27. Reyburn et al. (2011) *PLoS Negl. Trop. Dis.* 5: e952.
28. Matias et al. (2016) *PLoS Negl. Trop. Dis.* 10: e0004753.
29. Farmer et al. (2011) *PLoS Negl. Trop. Dis.* 5: e1145.
30. Pritchard et al. (2014) *PLoS Genet.* 10: e1004782.
31. Ferriéres et al. (2010) *J. Bacteria* 192: 6418-6427.
32. Millet (2014) *PLoS Pathog.* 10: e1004405.
33. Kenner et al. (1995) *J. Infect. Dis.* 172: 1126-1129.
34. Butterton et al. (1995) *Infect. Immun.* 63: 2689-2696.
35. Lazar et al. (1998) *Infect. Immun.* 66: 394-397.
36. Chiang and Rubin (2002) *Gene* 296: 179-185.
37. Bashir et al. (2012) *Nat. Biotechnol.* 30: 701-707.
38. Jackson et al. (2013) *Am. J. Trop. Med. Hyg.* 89: 654-664.
39. Azman et al. (2013) *J. Infect.* 66: 432-438.
40. Weil et al. (2009) *Clin. Infect. Dis.* 49: 1473-1479.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (51 sequences)

SEQ ID NO: 1 - protein, 1368 aa, Streptococcus pyogenes [sequence omitted]

SEQ ID NO: 2 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 3 - DNA, 96 bp, Artificial Sequence
  Description of Artificial Sequence: Synthetic oligonucleotide
cctgatgaaataaagcagtcgttttagagctagaaatagcaagttaaaataaggctagtccgttatcaacttgaaaaagtggcaccgagtcggtgc

SEQ ID NO: 4 - DNA, 96 bp, Artificial Sequence
  Description of Artificial Sequence: Synthetic oligonucleotide
tttttgtcgattatcttgctgttctagagagcgggagctcaagttagaataaggctagtccgtattcagtgcgggagcacggcaccgattcggtgc

SEQ ID NO: 5 - DNA, 100 bp, Artificial Sequence
  Description of Artificial Sequence: Synthetic polynucleotide
taaacaaagggagcattatagttggagaggcatgagaatgccaagttccaataaggctagtccgtacacacctaggagactaggggcaccgagtcggtgc

SEQ ID NO: 6 - DNA, 6 bp, Artificial Sequence
  Description of Artificial Sequence: Synthetic oligonucleotide
aggagg

SEQ ID NO: 7 - DNA, 2988128 bp, Artificial Sequence (residues 1-1,494,064 of 2,988,128)
  Description of Artificial Sequence: Synthetic polynucleotide
  modified_base (53787)..(53835): a, c, t, g, unknown or other
  modified_base (54202)..(54585): a, c, t, g, unknown or other
  modified_base (402705)..(402796): a, c, t, g, unknown or other
  modified_base (403412)..(403518): a, c, t, g, unknown or other
  modified_base (403868)..(403908): a, c, t, g, unknown or other
  modified_base (404972)..(405005): a, c, t, g, unknown or other
  modified_base (1128757)..(1128757): a, c, t, g, unknown or other
  modified_base (1344014)..(1344127): a, c, t, g, unknown or other
  modified_base (1841570)..(1841570): a, c, t, g, unknown or other
  modified_base (2049369)..(2049369): a, c, t, g, unknown or other
  modified_base (2049380)..(2049380): a, c, t, g, unknown or other
  modified_base (2156929)..(2156929): a, c, t, g, unknown or other
  modified_base (2412676)..(2417775): a, c, t, g, unknown or other
  modified_base (2586765)..(2586850): a, c, t, g, unknown or other
  modified_base (2711933)..(2711951): a, c, t, g, unknown or other
  modified_base (2712050)..(2712057): a, c, t, g, unknown or other
  modified_base (2712156)..(2712240): a, c, t, g, unknown or other
  modified_base (2712527)..(2712530): a, c, t, g, unknown or other
  modified_base (2712713)..(2712774): a, c, t, g, unknown or other
  modified_base (2712849)..(2713015): a, c, t, g, unknown or other
  modified_base (2713069)..(2713160): a, c, t, g, unknown or other
  modified_base (2713236)..(2713287): a, c, t, g, unknown or other
  modified_base (2961163)..(2961292): a, c, t, g, unknown or other
  modified_base (2961614)..(2961742): a, c, t, g, unknown or other
  modified_base (2961874)..(2961946): a, c, t, g, unknown or other
  modified_base (2962138)..(2962217): a, c, t, g, unknown or other
  modified_base (2962333)..(2962592): a, c, t, g, unknown or other
agggtcattaaatatatataaagatctatatagagatctttttattagatctactattaaggagcaggatctttgtggataagtgaaaaatgatcaacaagatcatgcgattcagaaggatcagatcgtgtgatcaaccactgatctgttcaaggattagctgggatcaaaaacctatgttatacacagccaccttgggatctaaaacttgttatatggataactataggaagatcaccggataatcgtatagttatccacatgagatttgattgaaaaagcatcaatcaattttttcactaccgttaaatttatccacaatccaaaaaaaagagcggcattaagccgctctgcatggaataggtcattatttagaagcgattgatgacgcgtttgagccaagcttcagcggcatcttcaggcactgggtgctcttgtacatcgatggtaaagcagttggccagaggtttagcaccaatatcccccagcagctgataggcatgtttacctgccgcgcagaaagtatcgtagcttgaatcaccaatcgcgaccacggcataacgtagtgcagaggtattcggtggtgtattctgcagagcctgaataaagggctggatattatccgggtactcaccagccccgtgggttgaggtgatgatcagccaagtccctttagcagggatctcactcatgttgggctggttatgaattttggtgtcaaagccttgttcttgcagtaaatcactcaggtggtcacccacatattccgcaccgcctagggtgctgccagtaatgatatgaatcatagcgttactctatttcccaatacagaatgatgaaaaaatgcggccaagcagatcatcggagctgaactcgcccgtaatttcgttaaggtgttgctgggctatacgcagctcttcggcgaggatttctccggccatatagccttcaagttgttgctggccaatcgctaagtgctctgcggctcgctctagggcatcgagatgacggcggcgtgccataaagccaccttcctgattgcctgaaaaacccatgcactctttgaggtgctgacgcaaggcatcgaccccttggcctgttttggctgataggcggatcaaggtgggttgattaacatggcagatcccaaggggctcaccagtttgatcggctttattacggatcacagtgatcccaatattctctggcagtttgtcaacaaaatcaggccagatgtcctgtggatcggtggcctctgtggtggtgccatcgaccataaacagtacgcgatcggcttggcggatctcttcccatgcgcgctcaataccaattttttctaccgcatcagaagcgtctcgtagtcccgcagtatcgatgatgtgcagcggcatcccatcaatatggatatgctcacgcagaacatcacgggtggtaccggcaatgtcggtaacgatggcagactctttacctgaaagcgcattgagtaggctcgatttacccgcattaggacgcccagcaatcaccaccttcatcccttcgcgcataatggcgccttggttggcttcacggcgcactgcggcaagattatctatgatggtttgcagatcagcggaaaccttaccatcggccagaaaatcgatctcttcttctgggaaatcaattgcggcttcaacatagatgcgcaggtgaatcagcgattccaccaaggtatggatgcgtttagaaaactcgccttgcagtgattgcagcgcggatttcgcggcttgctcagagctggcatcaatcaggtctgcgatggcttccgcttgggttaaatccatcttgtcattgaggaaagcgcgttctgagaattcaccgggacgggctgggcgcactcctttaatctgcaaaatacggcggatcagcatatccatgacgaccgggccaccgtgaccttgcagctcaagcacatcttcaccggtaaatgaatgaggattggggaaaaacagcgcaatgccttgatcgagctgttggccatcttcatcggtgaaaggcaagtattcggcatagcggggtctgagcgtgcgtccagtgactgtctgcgcgacgtgggcagccagtgggcctgatacacgaataatgccgacaccaccacggccgggtgccgtagcttgcgcgacaatggtatctgttgtcatagtgttacctgaacaggattgaattagcgccattgtaatcagcagccaacaaaaaggcgaccttttggccgcctctttattactcaatcaaacttacttggagtgtaagccttttttctctagcgctttgtagatcagcgtttgctggattagcgttacgatgttcgacaccaaccagtacagaaccagacctgatgggaaccacaggaagaagaaagtgaacatgactggcatgaaggtcatgatcttctgttgcattggatcggtgatcgtggtcgggctcatcttctggataacgaacatgctcgcacccatcagcagtggcaagatgtagtaaggatcttgcgcggacaagtcatgaatccaaccaaagaatggagagtgacgcagctctaccgactccatcagtgcccagtacagcgcaatgaaaatcggcatttgcagaaggatagggagacagccacccagtgggtttactttctctttcttatacagctccatcatctcttggctcatgcgctggcgatcatcgccaatccgctcacgcatcgcttgcagtttaggttgcagcatgcgcattttcgccattgaggtgtactgtgctttggtcagtgggtacatcgcaccacgaacaataaaggttaagcagatgatggccacaccccagttgccaacaaaggtctgaatcacagacagcaaccagtgcagtggcttagcaatgaaccacaaccaaccataatcaaccaccagatcaagattaggggctgttgcggccatttggtcttgcagttttgggcctacccataaggttgcttcaaactctgctttatcaccgttggcaatggttttgtttggtgtacggatacccatatcacctaaattattgataacgcgtgagtaaagctgtgcttgcggctcatcacgtgggatccatgctgaagcgaagtagtgctggatcatcgcgacccagtttaccgtcacatcgtttggtgcactgaggttgcgatctttcatgtcgtcgaagctgtacttcttgtaacgcacatcgctggttgagtaagcaccaccacggtaagttggcatggcgaggttgccaccagaatccagcagattttggcgcaggtgagcatacatacctagtgtggcttcgctacctgaattattggcgacgtcaaacaccacatccacggcgtagctaccacgcttaagaatgaaggttttcgtgtagtcaatgccattggcttgataggtcataggaatgcgcagttcatcttggccttcggccagagtgaaactatccgcactcacttggtaagcgggacgattattgctggtgacgtcaatgccttgtgggccgactaaaccactttgagcaataaactgatggccttgggtgttttgcaacaagacaaaagactcaggcgaattgagctcttctgagtattgattcagttttgcgctaaccacatcgccgccgagcgtatcaatagacagagtcagtacatcggttgagacggtaatggtcttggccttcgccgccacattttgtgcaggcgttggatctaactcatcggaaaatgaaggagcaggagctgcgcctgtggattgggcctgctgtgtcgcttgcggtgcagggttcttcgctacttgccattgttgaaacagtaggaaagaaaccagcgccagagcgattaacaagatattacgttgagaatccatcgttatttatctctgtcttgtttttggactggtggaacggggtcaaagcccccttcgttcaaagggtggcattttaatagacgtttggtggataaccaacatccttttataaaaccgtgagctcgcagcgcttctatcgcatacgtggaacaagtaggagtgaatcggcagcgtgggccgataagtggactaataaaccactggtaaagttttacaataccaatggctaaccacgagaagggcgagagaggcgttgccatagtttgccaagcaagttaaacagttcttcattgctcaaatcttgcgcgctctttttggcgatgacaacaaaatctttgttagccagttgattttgatgtaagcgaaagctttctctgcaaatacgtttgaatcgattacggccgacggcagttttgatctgctttttaggaaccgcgagtcccaaacgaggatgagaaaggttattagcgcgagcgatgattgtgagatgaggagaaccagcactgtgagcttgctggaagactttttgataatgttcgggagttaacaaacgtaactcccgattgaatgcgtacgtactcaaaataattcgagattattttgacaggcgcttacggccttttgcacgacgtgcattcagaactttacgaccgttcgcagtcgccatgcgagcacggaaaccgtgagtacgcttgcgcttcagaactgaaggttgaaaagtgcgtttagacatgatgttacctttactgatcagtagttttaggttcttggttaacccggcgtgggcattaaggtcttcactgaagacgccgacgcctctcaacaaagaggcggaattgtaatcactgtcacaaaaggtgtcaatgattgggttttccccagtctgaactcactcaatgagctggctcattctggttgccgctttatttccggtcggccgattatacggacaaaccgcaaaatctcaaggatccttaacggatcccgacttgattgaggaattttcttaagcgcggatcctgtggatggtcaaagatatcctgtggagaaccttgctcgacaatctttccttcggccataaagatcacccgatcggcgacttctttggcaaactgcatctcatgagtgaccaccaacatggtttgatgttgagtcgccaattttttcataagagccagcacttcacccacccattcaggatcgagggcggaggtcggttcatcgaacagcagcagttcaggttgcagcgccatcgcgcggccaatcccaacccgttgctgctggccgccagagagtgctgcgggatagctatcacctttatcgccaaggccgatatcatcgagaatttgctgtgctcgttggtgcgcttgagcttttttccagccgcgtaccgtgatcaaggcttctgcaatgttttgtcgcgcggttaaatgagcgaatagcgcatagttttgaaacacaaaaccggttttacggcgcagtgccagcacatcagctttggtatgtttttgggtatcaacggtgagttcatcaatacgaatactgccctgatcggcttgctcaagaaagttcacgcagcgcagtagagtggatttacctgtgccactggagccgatgatgaccacgatctctccgcgttggatttcaagatcaatgccttttagtacttcactggtaccaaaccttttgtggatattctgcaatttaatcatcgtgcgtacgccttattgagtttctgctctgcccaagattgcaggcgagtgagcaccaaaaccaccacccaatagatgagggctaccgccaagaaggcttcgaaaaaacggaaactggatgaagcttccatctgcgctttagccatgatctcagccacgccaagggtaaaggcgagggaggttgatttgatcatatcaatgaaatagttcatcaatgaaggcagagcaacgcgtgtggcttgtggcaaaatgatccggcgcatcgcctgagaagtggtcattccgacggataagctggcttccatttggctgcgatcaataccgatgatcgcggcgcgaatgctttccgccatgtaagcggcaaaatgtagcgttaaaccgatcaccgcagcgctgaatgcatcaagcccaaccaacagggggaagacttgcggtaaaccgtagtagagcaaaaataactgtacaagcagcggcgttccgcggaaaaaactgatgtagagctggctaaggggatccaacactggcactttgaatacccgaatattggctagaaacagcgccaaaatcagcgcgaaaactagcccccagctggccatttccagagtcgtacccagatatttgagcaagattggcagcagctcaagcatgtagtgaaagtcaaaacccatctgctttccttcctaaaataatcaaaggtgggaaagtcccacctttatagaatagagtctagcttggtgaagcagaattattgcgagatatcggtaccgaaccatttgagcgcgatttggcttaatgtaccgtcagcacgcatggcggcgagcgctttattgacttcaccttgcagttgctgacctttttcgttattcacaaatggccacgcgttttcgatagtttcaaacggtgaacccgcgagttgcagtggtaaaccggtcttttcgatcagctcaagcgcagacagacgatccatcacaaacgcatcggcacggcctaaagccacatcgtgttcaatgccggtatcgtaggttttgatgttgattttgccgtctttatcatggttgcgcaggagctgttcaaagttagaacctaaattaaccgcaacggttttgcccgctaaatcgtcaatgcctttaatcgcttcattgcctttacgcaccgtaatttgtgcaccatcaatcacatacggatcggagaatagatatttagccttacgtgcatctgtgatagtgatttggttagaaatggtgtcgatgcgcccagtttcgagcaggccaagcaaaccggagaagttcgcagtaacaaactcgaccttataatcattacgtttaccaatttcattccacacatccacttcaaagccttgcagctcgtcttgtttcacgaaggtgaaggggaaataacggcccgacatgccgactttcacctcggtagctgcctgaacggtggcagaagaaagggctagggcagccagagcgatgttaaaccagtgtttcattgtgtgactcctgtataatttatgtttatatcctactggcaattaaatcattaaaagaaataaccagtagttattaacaataactgatcaaaatcaaaaacatggggataactactaaagatcttgagatatgtggatctttatgtgggtagcacgggcaaaatgtgtgaggatcttagttatcggtcgaaaaataatgtgaataacttagatcttattcactggatcgacgatccagcgctggcgatctgagttatcaacaggtagaattgttcctctttaccgatcgttgatttttgagtgagggaatcgtgtcatcttcgctatggttgcaatgtttgcaacggcttcaggaagagctacctgccgcagaattcagtatgtgggtgcgtccgcttcaagcggagctcaatgacaatactctcactttattcgccccgaaccgctttgtgttggattgggtacgcgataagtacctcaataacatcaatcgtctgctgatggaattcagtggcaatgatgtgcctaatttgcgctttgaagtggggagccgccctgtggtggcgccaaaacccgcgcctgtacgtacggctgcggatgtcgcggcggaatcgtcggcgcctgcgcaattggcgcagcgtaaacctatccataaaacctgggatgatgacagtgctgcggctgatattactcaccgctcaaatgtgaacccgaaacacaagttcaacaacttcgtggaaggtaaatctaaccagttaggtctggccgcggctcgccaagtctctgataacccaggtgcggcgtataaccccctctttttgtatggcggcaccggtttgggtaaaacgcacttgctgcatgcggtgggtaacgcgattgttgataacaacccgaacgctaaagtggtgtacatgcactctgagcgtttcgtgcaagacatggtaaaagccctgcagaacaacgcgattgaagaattcaaacgctactatcgcagtgtagatgccttgttgatcgacgatattcaattctttgccaacaaagagcgttcgcaggaagagttcttccacacctttaacgcactgctggaaggcaaccaacaaattattttgacttctgaccgctatccaaaagagatcagtggtgtagaagatcgtctcaaatcgcgttttggctggggcttaacggtggcgatcgagccgccggagttggaaacccgcgtcgcgatcttgatgaaaaaagcggaagatcaccagattcatctgccggatgaagtggctttctttattgcgaaacgcctgcgctctaacgtgcgtgagttggaaggcgcactgaaccgcgtgattgccaacgccaactttaccggtcgcccaatcacgattgatttcgtgcgtgaagcactgcgtgacttattagcgctgcaagaaaagctggtcacgattgataatattcagaagaccgttgccgaatactacaaaattaaagtggcggatctgctctcaaaacgccgttcgcgctcagtcgctcgtcctcgtcaattggcgatggcactggctaaagagctgaccaaccacagcttgccagagattggcgatgcgtttggcggccgtgaccacacgactgtgttacacgcttgccgtaaaatcgagcagttgcgcgaagagagtcacgatatcaaagaagattattcgaacctgattcgtacgctttcctcttaatttgcgctatggttagcgcacttgcgtatttcgctttcacccgtttaagagaagactatgaaatttaccattgaacgtagccacttgattaaaccattgcagcaggtgtctggcactttaggtggtcgcgccagcttgccgatcttgggtaatttgttgctcaaggtggaagagaatcaactgtcgatgaccgccaccgatttggaagtggaactgatcagccgtgtgacgttagaaggtgaatttgaagcaggcagtattaccgttcctgcgcgtaagtttttagatatttgccgtggtttgcccgatagtgcggtgatcactgtgctgcttgaaggcgatcgcattcaagtgcgttctggtcgtagccgtttctcactcgccaccttacctgccagtgattttccgaacattgaagattggcaaagtgaagtgcaagtttcgctcactcaagcggaactgcgtggcctgattgagaaaacgcagttttctatggccaaccaagatgtacgctactacttaaacggcatgctgtttgaaattgatggcaccaccttgcgttctgtggcgactgatggtcaccgtatggcggtggcgcaagctcagctcggtgcggattttgcgcaaaagcagatcattgtgccgcgtaaaggggtgcttgagctggtgaaattgcttgatgcgccagagcaacctgtggtgctgcaaatcggccactctaacttgcgtgcagaagtgaatcactttgtgtttacttcgaagctggttgatggtcgtttccctgattatcgccgtgtattgccgcaacataccagcaaaacactacaaacgggctgcgaagagttacgccaagcattttcgcgtgccgcgattctatcgaatgaaaaattccgtggtgtacgggttaatttggctgacaacggaatgcgcattaccgccaataacccagagcaagaagaagcggaagagctactggatgtgagctttgaaggcgagccgattgagattggctttaacgtcagctatatcttggatgtgcttaacaccctgcgctgcgacaatgtgcgcgtttcgatgtcggatgccaacgccagtgccttggtggagaatgtcgatgatgacagtgccatgtacgtggtcatgccaattcgtctgtaaggtataaccgagttaccatgccgctttcccggttaatgatccaacagtttcgtaatattaaagcctgtgatattcgcctatcagcaggctttaactttcttatcgggccgaatggcagcggtaaaaccagcgtgcttgaagcgatttatctgctcggccatggccgttcatttaaaagctcgctgaccggacggatcattcaaaatgagtgctcagaactgtttgtgcatggccggatttgtgagcattctttgagctctgatcaatttgagctacccgttggcattaataagcagcgtgacggctcaactgaggttaaaataggcggccaaacagggcaaaaattggcgcaattagcgcagattttgccactgcaattgattcatccggaaggctttgaactgctgaccgatggaccgaaacagcgtcgggcttttatcgattggggcgtgtttcatactgagcccgcttttttcgatgcatgggggcggtttaagcggctcagcaagcagcgtaatgcactgctaaaaagcgcgcaaagctatcgtgaactcagttattgggatcaagaattagcccgtttggctgagcagattgaccagtggcgtgaaagttacgtcaatcaattgaaaaatgtggcagagcagttatgtcgcacatttttgccagaattcgatatcgacttaaagtattatcgaggttgggaaaaagatcagccttatcaatcgattctggaaaaaaacttcgaacgggatcagcagttgggctatacctttagcgggcctaacaaagcggatttgcggattaaagtgaacgcaaccccggtggaagatgtgttgtcgcggggacaactgaagttgatggtgtgtgcgttgcgcgtggcgcaagggcagcacctgaccgagttgacgggaaagcaatgcatttatcttatcgatgattttgcttccgaattggatagcctacgtcgccaacgtttggcagatagcctaaaagggacgggggcgcaggtttttgtaagttctattaccgaaagccaagtggcggacatgttagatgagtccagtaaaacatttcacgttgcccacggtgtaatagagcaaggataaacagagtgagagagtaactcatgtcgaacaattacgattcatcgagtattaaggtactgaagggtctggatgcggtacgcaagcgtccgggtatgtacatcggcgacactgatgatggcaccggtctgcaccacatggtttttgaggtggtggataactcaattgatgaagcgttggcaggttactgtaaagacatcgtggtcaccatccacgaagacaactcagtgtcagtcagcgatgacggtcgtggtatcccgaccgaaatgcatcctgaagagaaagtgtctgcggcagaagtcatcatgactgtactgcacgccggcggtaaatttgacgacaactcctataaagtctccggtggtctgcacggggtaggtgtgtcggtggttaacgcgctttctgaaaaagtgctgcttaccatttatcgtggtggcaagatccattcgcaaacttaccatcatggtgtgccacaagcaccgttggctgtggtaggtgagacagagcgtaccggtactaccgtacgtttctggcctagtgcacagacttttaccaatatcgaattccattacgacattttggctaaacgcctgcgtgagctgtcattcctgaactctggcgtgtcgatcaagctgaccgatgaacgtgaagaagataaaaaagaccacttcatgtatgaagggggtattcaagcgtttgtgacccacttgaaccgtaacaaaacgccaatccatgagaaagtcttccactttaaccaagagcgtgaagatggcatcagcgtggaagtggcaatgcagtggaacgatggtttccaagaaaacatctactgctttactaacaacatcccacagcgtgatggtggtacccacttagccggtttccgtggtgcgttgacccgtactttgaacaactacatggacaaagaaggcttctcgaagaaagcgcaagcggcaacctcgggtgatgatgcgcgtgaaggcttaacggcagtggtttcggtgaaagtgccggatcctaaattctcaagccaaaccaaagataagctggtttcttcggaagtaaaatccgcggttgagtcagccatgaatgagaagctggcggatttcctagcggaaaacccaagcgaagcgaaaaacgtttgttcgaagattattgatgcggcgcgtgcgcgtgaagcggcgcgtaaagcccgggaaatgactcgccgtaaaggcgcgctggatcttgctggcttacccggcaaactggcggattgtcaggaaaaagacccagcattgtctgaactctacatagtggagggtgactcagcgggcggttcagccaaacaaggccgtaaccgtaagaatcaagcgattctgccgctgaaaggtaaaatcctcaacgtagaaaaagcgcgttttgacaagatgttgtcttcacaagaagtcgcgaccctcatcactgcattaggctgtggtatcggccgtgatgagtacaacccagataaactgcgttatcacaacatcatcatcatgaccgatgcggacgtcgacggctcgcacattcgtactctgctgttgacctttttctaccgccaaatgcctgagttgattgagcgtggttacatctacattgctcagccaccactgtataaagtgaagaaaggcaaacaagagcagtacatcaaagatgaagaggcgatgaaccagtaccaagtggcactggcgatggatggtgcagagctgcacgtgaatgccgatgcgccagcgttagcgggtgaaccgctggagaagctggttcagcaatataacgccgcgatcaagctggttgagcgcatgagccgccgttacccttacgcgatgctgcatgagctgatttacgtaccacgcatcaatgccgagctgtgtgcggataaagccgcggttgaagcttggacacagcgtttagtcgaacagttgaatgctaaagaagtgggtgcgagccaatacagcgttctggttgaacacaatgctgagctgaatgtgtacttgccaaaaattcaggtgcgtactcacggtgtgactcatgaatacttactgagcgcggatctgatcaactcgaaagagtacgctaagttagccgatctgtcggaagcgctggacggtttgattgaagcgggagcgtttatcaaacgtggtgagcgagtacaaccgatcagcagctttgccgccgcgctggattggctgatcaaagagtcgcgccgcggtctgtctatccaacgctataaaggtctgggcgaaatgaaccctgatcagctgtgggaaactacgatggatccagaaacgcgtcgtatgatgcaagtcactatcgaagatgcggtaggcgcggacgaactgttcacgacgctcatgggcgatcaagttgaaccacgtcgtgcatttatcgaaaccaacgcactgaaagtggccaacctcgacgtataagcgtttggttgattaacaatctgcgataaaaaagcagcgctgtggcgctgctttttttatctctgcattttgtcccttccctctgttggatgacggcagcctcaagcaatgacaaaagggagccataaaaattttgtgtcgaatatcctaggttgttgggctaaagcaccaaaatcagaggttaactaagacttttctatcctgaaaacagctttattagactttccttttttctctaaatttcatgaggttgcattcatttttttagtgtctatagtggtctgtgaaccctatcgttattccttatttttttgactggaggtcaggatggtcgcctttgtgaattgaaccgggagtgtatttcactcccgggcatactcatcgatttgtcactgttggtaatggaatgagcaaaggaagtatcatgctgaatcggttatctttgaatattcggcgttttctcgccggttggtggctacgtagccgctttttgacctatcaatctccgctgttgctgctcgaattgttcgagaagctggagcatcctcgctcgcccattgaacgagcgccacagcgcattaagcttggggatacggtgagccttgttgatgctcatcgtcagttgtcgtttcaagtcactctgaccacgtctgaaaatcagcacgaagtccagggtggcgtgacgtgcgattccctacttggtgccgctttacttggccgtcgtcagcatgaagtgtttaccttgtcgatttggggacaaccccattgctttgccattactcacgttcagcactcaatgcagggtaagccaaccaagctttgccatgcttgttatgtcagtaattaggagtttgtcatgagtaaacaagagatgaaaaaaccacaactcagcctcaaagagaagcgcaagctgaagcaagaaaaagcgcaagagagctcagtgattaagccacgcaaaagcaaaggccgttaattaaggataaagtgcattatccaaatgactagcccgactcaatgtcgggctttttttcaaaaaaatttttgggcaaaaacttgaaatggttttgagtgaccttatatctagaattgaagaggatgccgctaggacctctgaatgagactaacacccttgctcaattgaggagtgtgttacctaactgaaatcacgccgattcaggtcataagaatggatcgagcgacttaacaagtcattgttaagactattgcttaatcaaagaggataggaatatgagaactgtagattttactccactgtaccgcaacgcgattggctttgaccgtctactgaacatgatggaaaacagcgcggcgaaaaacgcccaaggcggataccctccatacaatatcgagcaaaaagaagacaaccaatatcgcattaccatggcggtagcgggttttggcgatgaagagatcgatattactcaacaagagaatactttgattgtgcgcggtgagcgtaaacctgaagagagcaaaaactacatctatcagggcattgccgagcgcgattttgaacgtaaattccaattagcggattacgtgaaagtgactggcgcgactatggaacatggtctgctgcacattgatttagagcgcgaaattccagaagcgatgcagccacgtaaaattgcgattaacggcaagcacctactggaaaacaaataactctgcgcagcgttttaacgcactgaacgcgagataaaacgaagcccgcgaatttcgcgggctttttgcattgcttagtttgggtgtttagacgttggcttgttgatacgctttttgtacttcttcggcgatgatggcaatgccttgttccatcgcttgctcgttctgcacatagttcatacgcaagcactcatgagcgtgtggccattcttgcggctggccgataaagaaatattcgcccggtacaatcaataccccacgcgctttcaaacgttggtaaagctccattgtggtgatcggcagttcatcaaaccacagccagaggaagatcgccccttcgggtttatggatgcgaaaacgcggatccgtaatcgcactttgcagcagctctaccgcatgttgcgctttttggcgataaaacggcttgatcacctgctcgctaagtctcagcagatcgcctttttctatcatgcgttgcaccagtgcgggtcccatactgccgggtgctaagctaatgatgccattcatgttggtcagcgcttgagttaccgcttcattggcgatcacaatgccgcagcgcagaccgggcaagcccagtttggataggctcatgcacaagatggtgttgtcattccaaaacggttcaatgtcttcaaaaatgatattcgggaatggcacgccgtaagcattgtcgataattaacggcacaccgttatcacgtgccagttggtcgagtttgtggatttcctcttcggttaacacgttaccggttgggttggtggggcgagacacacagatcgcggccaccgattcatcgactttcagctcagaaaagtccacatggtatttgaacagtccttgatcgagcagctcaatctccggacggtaggagacaaaaatatcgtcatcaatgccagcatcaccgtagccaatgtattcgggcgcgaggggtaggaggatttttttgtgtgcaccatcgggctgtttaccggcaaacaagttaaacaggtagaaaaagccactctggctgccgttggtcaaggtgatgttcttttcgctgatattccagccatacgtctcacgcagcagtgtagcgagcgattttacaaacacatctttgccctgtggaccatcgtaattggtcatggcattgagcagtgaaccatcggccaacatttcggcgctggtgttatggaaataatcgagcatggcagggatggcagcaggattaccgccaccaagcatgatcgcgcctggagtgcgcagaccatcgttcaaatcatccattaactgggtaataccggagtagcgattaaacttttcgccaaaagaggaatactgcattgctcgactacctaatgattgctgtgtgtttgcgaaacgatataccggtggaatctccgccgtttagaatagttcttgaacataccgcaatgtatttgcgaggcaaagcaatatttttgtgtccccttcctacttgaagctgcagcggtgttggcggcgttcgttcaccccaatcacatagtttatctatgctcatggggatgaactcacttgtcgcctacctgcaactccaagtcgtttggggagcgcgagcaaaaacaaagcccaactcttttgagttgggcttaaagtttgttgacgaaattgtcgtgctgcagattatttttgcagcagcgaaatgtcggcaatttgcaggaacaggttacgcagcttgttgagtagcgtgagacggttcttcttcagtgcttcatcgtcagccatcaccatcacgttgtcgaagaaggcatcgacaggcgcgcgcaggccagccagtttgctcagagcttcttggtagttgccggttgcaaacgcaggttctaacgcttctgccatgatttcgacggcttcggctaaggctttttccgcatcttcttgcagcagagcgagatcgatttcttcacccaattcaccatcgtacttagccagaatgttgcctacacgcttgttggcagcagccagtgcttcggcttcttcaagagcgcggaagtgcgatacggctttcacacgctgatcaaagtcggctggtttggttgggttacgcgccagtaccgcttggatgatgtcgatgctaaaaccggcatcttggtaccaggttgggaaacggccaagcataaactcgatcacttcctgctcaacgttggcgttagtcaggcggtcaccaaacagtgatttggctttggcgatcaaatccaccagatccaactggtagccgtactcaaccagaatacgcagtacacccagtgaagcacgacgcagcgcaaatgggtcactgcctttcggcgcctgaccaataccaaatataccgacgatagtatcgagtttgtcagccatcgcgaccgcagctgaaacaccacggcttggcagttcatcacccgcgaaacgtggcatgtactgctcattcagcgcaactgcaacttcttctgcttcgccatcgtgacgcgcataatgcatacccatcacgccttgggtgtcggtaaattcaaacaccatcgaggtcattaggtcacattttgccagtaggcctgcacgcttagatttctccacgtcagcaccgatctgctctgcgatgtagccagccagttcagtaatgcggtcggttttgtctttaatcgtgccgagttgctgttggaaaatcgcgttttcgagcagaggtaagcgatccaccaatgggcgcttgcggtcagtattaaagaagaactctgcatctgccagacgtggacgaactaccttctcgttaccttccacaatgtggcgaggctctttcgattcgatgttcgaaacgaagatgaagttaggcagcagttttttgcttgcgtcatagactgggaaatatttttggtcacctttcatggtgtacaccaaagcttctgctggaactttgaggaatttttcttcaaatttcgccgtcatcaccactggccattccaccagcgaggtcacttcttctaccagcgcatcttccagatccgcgataccgccgagctgctgagccgcttgttgtgagccttcgatgatcatcgctttacgagtcgcgtagtcagcgatgactttgccgcgctcttcaaggatcgcagggtactgctcagccgattcgatggtgaattccgcttcacccataaagcggtgaccacggagggtgcgtgcagaagcaacacccaagatttcgccttggatcagttcgctaccaaacagaatggtcagagtttttactggacggataaattgggtttctttgtcgccccaacgcatcggtttcgcaatcggcaggttagccagcgctttggccgccatctccacaaccacagaagcggtttgttggccttgcacttgttctttgaagagcagccattcgcctttgtctgtgacgagacgttctgcttgctctaccgtgatgccattgccacgcgcccagccttcagcggctttggttggcttgccatcggcatcaaacgcaacgttgacggcaggaccacgtttttcaacgacgcgatccggttggctttctgccaaattggccactttcagtgccaaacggcgtggcgtggcaaaccaagttacgccttcatgggcgatgtcagctgttgccagttctgccgcaaaattcgccgcaaaggcttcagccagtgtgcgcagttgctttggtggcagctcttctgtgcctagctcaattaaaaattcttttgccatgtgacgtcttccccttacttctgttctgacttcttacacatagggaagcccagagcttcacgggatgcgtaataagcttcggcgaccgatttggttaggttgcgaatgcgcagaatgtagcgctgacgctcagtcactgagatcgctttgcgtgcatcgagcaagttgaaggcgtgtgccgctttcaaaatacgctcgtaggctggcagaggcagtggcttttcaagctctagcaggtatttacactctttttcacactggtcgaagtaagtgaagaggaaatccacatccgcgtgttcaaagttgtaagtggattgttcaacttcgttttggtggaagatgtcgccgtaagtcactttgcccagtgggccatcggtccagaccagatcgtaaaccgaatccacgccctgaatgtacattgccagacgctcaataccgtaagtgatttcgccggtcacaggcttacactcaagaccgccaacttgctggaagtaagtgaactgagtcacttccatgccgtttagccacacttcccagccaagaccccaagcacctaaggttgggttttcccagttgtcttccacaaagcggatgtcatgcacacaagggtcaacacccagtacacgcagtgaacctaggtacagctcttggatgttgtctggtgagggtttgatgatcacctggaactggtagtagtgctgcagacggtttgggttttcaccgtagcggccgtcagttgggcggcgtgagggttgaacgtacgcggttgcgataggttcagggcctaatgctcgtaagcaagtcatcgggtgagaagtacctgcacccacttccatgtcgagaggttgcacaatagtacagccttgttgggcccaataatcctgcagcgcgaggatcataccctgaaaggttttgatgtcgtatttttgcatagtcaggttcgcgcgattcttctgtctgaattgataaaaaataacactgaagtatacccagatattccctgacaaagtagcggaaatcttgctgaattaatcgacaataatttcttttacgctcatttttcccgacttttgtgccaatttctctctgagtcatggaaaagtgggtaacgagggttgcgattctggattccggtggttagaattcgctccgtctttggggagtagctggtctctaagttttcaacttggtgattcacacatcaacatatttggtactcaattaccatggtgtgtgagacctgagccttcaggtttagcaagaccttagacaaacaacgcgaactgggatagggcgtgattgtttgtctacggttcgataataaatccctgtcccacagagcatgtcatgagcgttttagctatttcgattactactgtggctttagccgagatcggggataaaacccaactgttatccttgttactcgccagccgttaccgtaaacccattccgattattgccgccatttttcttgcgacgttagccaatcatgcactggccgcttggttaggtgtggtggtggcggattatctttctcccgacattttaaaatgggtgttggtggtcagtttccttgcgatggcgggttggattctcatcccagataaattggatggagaagagtctatctctactcgcggtccttttgtggcaagttttattgccttctttatggctgaaattggcgataaaacccaaattgccacctcgattttaggggcgcagtatgccgatgccctcagttgggtgattgttgggacgaccttaggtatgttgcttgcgaatgttccagtggtgctgattggtaaattgtccgccgacaaaatgccgctgggtttgatccgtaaagtaacggcagggttattcttgctaatggcactggctacggcgtttttttgagtcgtaacgcgcggatttcgactgtgcagcgtgacctatcacccatcctgatgtggattatcatgctagggtatgagcagggttcaagagtaagagtacaccattatgctgactcgttacatggggatgacaccaaaaagccagagttacttattcagttttggcttagtgttaacgttactcggtatggcgttaaccgatttatggatgccgatggtggtgggcgcgattgtgatgacggcgttagcggtcgaatcttggattcgcgttgcccatattattccgctgcacgatgaagtgcgaacgctgcaaaaacaactcaataggttgcaagcagagctgcgtaacctcgaagaagagtaaatcagattgctatcaaaaaagactgcctcggcagtcttttttattgtcatccctaaaccaccgcttttagcggtagtgattgtttgttaggccaacccttttttaatcaggtactgataaggcagttggtcgatctgcgcaccgagtaattggtgatccataaagcggcagaagctgggaatatcacgcgtggtggaggggtcatcggccgtaaccaataacacttcgccgtctagcatcgtacgaatggttttcctgaccatcatcactggctctgggcagcgtaatccttctgcttctaaagtatgcgtggcaatgttcggattgaaagtcatgctaaaacctgttgggtgtcacaattaaggcgtagatgatactggtggagaaaaattattcaataatcgcttggcaaaaggatcattttgttataacttccttaacaagttagtaacaagttgagcgagggaatgatgttaaccacactcgatagactgaccatctatgccgttttgtgttttatttccttgtgtgctttgggcttgggagagaccacacaagctcaattgatgccagtgttaggtactgctgcctccatctttggtatttggctagagatgcgtagcgaacaagacaccactcagcaaccacatcgttaaccaacgtgactgactacgctcaattacattccgacactatccccatttttcttgggcttccccgctgaaaggcgggatttttttgcctgctatttataaccagataaggttcacaatgagaaacccgccaacagtgcgggtttctttccattcgaatcaatacgttttggcttagagtttaacgaccacgcggcctgtcacttggccattagtaatcgcttcggcgtattctggcacttgtgacaagctgatttcgtggcacgcttgagcgtagtagcttgcaggcaacaactccgccagcttcttccatgcagcaaggcgtttctcgacagggcaagagacggagtcaacgccctgtaaacgtacattgcgcaggataaatggcatgactgtggtcggcagatcaaaaccacctgccagaccacaagcggcaacgaccccgttatagtgcatttgtgccagcacttttgctaacactttactgcctacggtatcgaccgcaccaacccagagctgtttttcgagcggtctggaggcttcactaaattcttggcgatcgataacgcgcgaggcaccgagttgttctaaaagagggccattctgtgctacgcgtcctgtcaccgccacgaccttatagccaagctgagcaagtaaagtgacggcgacagagccgacaccgccactggctccggtgactaagatttcgccatcttccggtttgatgccaccgtcaatcagcgcctgtacacacaacatggcggtaaagcctgcagtaccaatcatcatggcttgctggctggttaagccttgtggcaatttcaccaaccaatcggcatttaatcgcgctttttgcgccatgcccccccaatgattttcacccacaccccatccggtcagaaccacggcatcaccgacttgataacgcgcatcggctgattccaagactgtgcctgcaaaatcaatccccggaaccataggaaattcacggataattttgcctttgccagtaatggcgaggccatctttgtaattgagtgaagagtagttgaccgctaccgtcacattgcctgcgggcagctgatcatcgttaatttgagtgaccgtcgcgtgagtgattttgtcttgttgagtaagcagcaacgcgttgaacatatgggatttccctctgttatgccttttctacctgaatggacaagtagtcgggtatggatggtaaagccaagcgaaagcgaggagtatgccagcctatctatagagcggactggatatagaacaagttttagcaagaattgttcaggaatgaaatggttgatttttcaacacttgaccttggccacttcgctcgatgctgatggctcgccggtaaagagaaagagccccacataaggtggggcgaagattatttagctaggaagaaacgatacgcagggttatcggtttcatctttatagcgataaccgagttcaaccaaatgctctgaaaagcgcactaggtctggtgtatccagttcaaaaccacacagcacgcggccgtagtctgcgccgtggttgcggtagttgaacaagctgatgttccagtgggtgccgagcatgctcaagaatttgagcagtgcgccggggtattcaggaaactcaaagctgtacaaacgctcggtcagtggtttggaagggcgaccaccaatcatgtagcgaatgtgtagcttggccatttcatcatccgagagatcttgcaccggatagccggattggcgcagctcgtgaatgatcgatttcagctcatctgggccgccgactaaacgcacaccgacaaaaatattggccagttgatcatcattgtaacggtagttaaattcggtgacggcgcggttaccaataatttggcagaagtcgaaaaacgcccctttgcgctctggaatggtcaccgccagtaagccttcgcgtttttcacccagttcgcagcgctccgacacataacgcaaaccgtggaagttggtgttggcgccagaaagtaccgtacccaactgtttgcctttgagctgctgctgttcggcaaatttctttagtcccgccagcgccaatgcgccagaaggttcagcgatggcgcgcgtatcttcaaaaatgtctttcaccgccgcgcagatttcatcactggacaccgtcacgtggccgtcaatgtattgctggcaaaggcgaaaggtttcatcgccaattcgttttactgccacaccatcagcaaacatgctgacttgatccagcaccacaggtttacccgcatctaaggctgctttgaggcaggctgagtcttccggttcaaccgcgatgacttggatctccggcatcaactgtttgaccagaaccgccactcccgccgctaaaccgccgccaccgaccggcacaaaaatgtaatccaaatgaccgttttgctgcagcatttccatgccaatcgtgccttgaccggcaatcaccaaagggtgatcgaacggaggtacaaaggtgtagccttgctctttggataaacgttcggcttcggctttggcttcatcgaaattgctgccatgcagcagtacttcgccgccaaatccgcgtaccgcttcaactttaatgtctggcgtggtgcgtggcatgacgatggtggttttgatgccaagtttcgttcctgacagcgccataccttgggcatgattacctgcggaagcggcaattacgcccgcggctttttgtgcttcggttaggtgcgacaccatgttgtaagcgccgcgcagtttaaacgagtgtactggctggcgatcttcacgtttgatctgcacttggttaccaatccgcgccgaaagacgcggcatggtttgcaatggcgtgacgttcgctacctcatacaccggagagcgcaagatctggcgcagatactctgcgccagtttgattggttaaccccatggcttagccctcaagtttggacttatcgcgcactgcacctttgtcggcgctggttgccatgctggcataagctttcagcgccaaagaaacggtacgctggcgatccactggtttccagccgagtttatcttgttcagcgcggcgagctgctagctcagattcgctgacttcgagcgtgatcgaacggttgggaatatcaatcgcgatgctatcgccactgcgtaccaagccgatcgtaccgccattcgccgcttccggagaggcgtgaccaatcgacaagccggacgtaccaccggagaagcggccatcggtcagtagcgcgcactgtttacccagtcccatcgatttgaggtaggtggttgggtagagcatctcttgcatgcccggaccgccttttggcccttcataacgaataaccacgacgtcaccggctttgacttggccgccaagaatgccgttgaccgcgtcttcctgactttcatacaccacagcaggaccacggaatttgaggatactttcatccacgccagcagtttttacgatgcagccgtcaatcgccaagttgcctttgagtacggcaaggccaccatcttgactgaatgcgtgcgctttatcgcgaatacacccctcttggcgatcgtcatcgagcgtatcccaacggcaatcttgtgagaaagcttgagtggtgcgaatgccagcagggcctgcgcggaacatagtatgtaccgctggatcttgggtttgtttcacgtcgtattgcgccagctgctcttgcagcgagatgcctagtacggtgcgggtttgatccttgagtagacctgcacgttgtagctcacccaaaatgcccattacaccgcccgcgcggtgtacatcttccatatggtatttctgagtggaaggcgcgactttacataagtgtggcacttggcgagacatgcgatcgatatcggtcatatcaaattccacttcgccttcctgcgcagcggccaacaggtgtaacaccgtgttggtggagccgcccatcgcaatatccagcgcaatggcgttttcaaacgctgctttgttggcaatgttgcgtggcaaaactgaggcatcatcttgctcgtagtaacgtttagtcagctcaacaatccgttgcccagcagtcaaaaacagctgtttgcgatcggcatgcgtggcgagcagtgagccgttacccggctgagagagacccagcgcttcggtcaagcagttcattgagttggcggtaaacatccccgagcaagagccacaagtaggacaggccgagcgttcaatctgctcactttgggcatccgatactttggggtcagcgccttgcatcatggcatcgaccaagtcgagcttgatgatttggtcagaaagcttggtttttcccgcttccatcgggccgccagagacgaaaatcgccggaatattaaggcgcatcgccgccatcagcattcctggagtgattttgtcacagttggagatacacaccatggcatcggcgcagtgcgcattgaccatgtattcgacggaatcggcgatcagttcacgcgatggcagcgagtagagcatgccgccgtggcccatggcgatgccgtcatcgaccgcaatggtgttgaattctttggcaatgccgcccgcggcttcaatttcgcgtgcgaccagttggccgagatcttttaaatgcacatggccgggaacaaattgggtgaaggagttgaccaccgcaatgatcggtttaccaaaatcttcctctttgacgccggtggcgcgccataatgcgcgcgcacccgccatgttacgtccgtgtgtggtggtggcggaacggtacttaggcatggaaactccttacttcgctgctgggtaaacgtaatccaaccagccccacttatcttctgtggtgcctttgaacagaccaaagtaagcatcttgtactaccttggtgatggggccgcgcttgcctgcgcctacggtaatcttatccacgctacgcacgggaaccacttcggcggcggtacctgtcatgaaaatttcatcggccagatagagcgcttcacgggagatgttggcttcgcgcacttcataacccatgtcgcgtgccagcgtcatgatcgaatcacgggtgatacccggcaggatagagctggtggtcggtggggtcaggatcacgccgtttttcaccacgaaaatgttttcgcctgcgccttcagagagataaccatccacactcagcgcaatgccttccgcgtaaccgtggcgacgtgcttcgccaccaaccagtagagaagataggtaattaccgccagcttttgccgcggttggaatggtgttcggtgccgcacgatgccagcttgaaaccatggcatccacgccattttctagcgcttcttcaccgaggtaagccccccaagggaaagcggcaatcatcagatccatttcagtgccgactggcgggcacacgccaagacccacgttacccacatacgccaatgggcgaatgtaagcgttatcgagtttgttgacgcgtaaggtttcgcgcgtcgcttccatgatggtctcgatcgaataagggattggaaagcggtagattttggctgaatcaagcaggcgctgcgcgtgttcgcgatggcggaagatgatagggccttttggggtgttgtagcagcgaacaccttcaaacaccgaagtgccgtagtgcattgcatgggtgagtacgtgaacggtcgcattcgcccatgggatcatctcgccattgaaccaaatataatcagcagtttttgttgccatgattgccttccttatgcgcaaatcttttgttgtaagttgttattgggcagctcgtcatttctgatcgctgtgacttccacagtacgcacatcccacagtttttcaatttgattggtcagggtcgtgatcggtctgtcactgtcgacaatgatctcaacgctggcgattttgctagcatgattttgggttgccgcgacttgcttgatgacaaatccacgatgacgcgttacgcgcaatacgcgctctaataacaccggtttatcgtccgctttaatatcgagtagataacgttgcatgtggcctctccttaggtgttctcaagcatgtcagtgttggatgcgcccggtggcaccagtggccacacgttctcttcttcatcaatcagcacgtgcagcagataagcggttttgctggccagcatttcacgcagcgcaggttcgacttcttctttgcggctgatggttttgccggggatgttgaaggctttggccagcatcacgaaatctgggttgtcatccaaaatggtttcgctgtggcgaccatcaaagaacagtgattgccattggcgtaccatgcccaaacgttggttatccagtagcaccattttgacggggatctggcgacgcttgagtgtgccaagttcttgcacgttcatcatgaaagaaccatcaccactgatcaggatcgattgatcgtcaggacgcgcaaccgcagcacccattgccgccggtaaaccaaagcccatggtgccaaggcctgcggacgagatgaagttttgtggtgcgcgcggttgaatgtgctgcgcggcccacatttggtgttggccgacatcggtcgagacaatcgaagagtccggcatcatgtccgacagttgcttgagcagcagtggtgcgaagatgttgtcgcccggatgatcgtagcgccatttgaacccgctacgcaggctctcactatgatgcacccaaggggagatgtcgtggctcagttccaactgcggcaggatgaggttgatatcaccgcgcagtgcagcatgggcatgacgcagtttgttgaactcggcggcatcaatatcgacatgaatcactttggcatgaggcgcaaaggtatcgagcttgcctgtcacgcggtcatcaaaacgcgcaccaaccgcgatcagcaaatcacactcttgtacgattaagtttgccgctttggtgccgtgcatgccgagcatgccaagatagtgtgggtcgtgacgctcgatggtgcccaagcctttgagtgtgctcactgaaggcataggattgaggcgtaaaaactcacgcactgtgtctgtggcattcgccagttgtacacctccacccacatacaatacagggcgtttgctttgtgcaagtaaggcttgcgcattcgccagatgtgttgcatccacgtgtggcatggcgggtggagtaaagcttggcaaagcggagaccggcgctttgccgagctgtacgtctttggctatgtccaccagcacggggccgggacgaccggtctgcgcgacctcaaacgcttcggctaacgtgggtgctagctcgttgatgtcggtgactaagtagctgtgcttggtacaagagagcgacatgccgatcacatccatctcttgaaacgcatcggtgccgatgtgtgagctggccacttggccggtgatggcgaccagcggaaccgaatcaagaaaggcatccgccaaacctgtcaccaagttggtggcgccggggccagatgtggccatgcacaccgccactttctgcgttgagcgcgccataccaatcgcggccatcgccgcaccttgttcatggcggcagaggatgtgctcaacacctccgtcatacagcgcatcataaatcggcatgatagcgccgccagggtaaccaaaaacggttttgatgccctgttgtttcaatgcggcaacgactaactgtgctccggtcatcgtgcctccttatggcaacaatacgtgtcgctgccttcctgtgtgttgtgtttgcacttcatgtgccgctcccattcttcctgcgtattctgggggtattccaacggataagtactgacctgtatctatccgagcttgggtataacctgttcagaatgtgctttttttagtctgtctgagttgtaaaaaaacccccggacttttcagtgcgggggtttttttggatttggttacttatttttcgcccactcgcccccgcgtcgtcactagaatgaccacgataattaggttaattagagcgttgatgcgagcgttcaagttcatagtaaagtcgttttttagggttgaactaatatcttaccaatgtgtttgcgcttctagtgttaacacacatcttcgttacatgacaagcaaaaactcattcttttttcacattcccgttttatctcaccacgctatataacccattctgtgctttttatcgccacttattcaggcgctgaaggctttttgatcaaatactaagggaagcaatgggacttgcgatcattcatagccgcgccagtattggcgtgcaggcacctccggtcacggttgaggttcacatcagtaacgggatgccggggtttaccttggtaggattgccagaaaccacagtaaaagagtcgcgcgatcgggtgcgcagcgcgatcatcaattctcgctttgagtttccagcgaagcgcattacggtcaatttagcgccagccgatttacccaaagaggggggacgttttgatttgccgattgcacttggcattttggcggcctcggatcaaattgcgcgaaataagctcgaaagttacgaatttatcggcgaattggcgctatcgggcgaaattcgtggcgtgaaaggggttttgcctgccgcgctcgcggctaaccaagtggagcgctgtttggtggtgccgcacagtaatggtgatcaggcggctttggtcggggttgagcggcataagtcggcgcaaagcttactcgaagtgtgcgcagacttgtgtggtcagcaaactctatctttgtttcaaagttcgcccagtgtgcaacaagtaagtcagacccgcgatctgcaagacatcataggtcagcagcagggaaaacgagctttggaaatcgctgcggctggcaatcacaacctattgtttctcggccctccggggacgggtaaaaccatgctcgcttcacggctgtgcgatttactgccagaaatgagtgatgaagaggcaatggaaacagcttcgattgcctctcttacgcagcaagagattaaccaacataactggaagttacgcccttttcgtgcaccgcaccattcaagctcaatggcggctttggtcgggggcggcaccattccgcgccccggtgaaatttctctcgcccataatggactactgtttttggacgaaatgccggagtttgagcgtaaagtgcttgattcactgcgtgaaccgctggaatcgggtgagatcgtgatttcgcgcgcgcaggggaaaacccgttttccagcacgctttcaattggtcggcgcgttaaatccaagccccacgggctactacgaaggcagtcaggcgcgtgccaatccgcagagtattttgcgctatttgagtcggctttcgggccctttgttggatcgctttgatatgtcgattgagatcccagcgttacccaaaggtacgctcgccaatgggggcgatcgtggtgaatcgacggcggctgtgcgccagcgagtgtgggtagcgcgtgagcgtatgttggcgcgatcgggcaaagtgaatgctttgctgcaaagtcgagaaattgaacagtattgccctttgcttaaagcggatgcggaatttctagaaagcgcgctgcatcgcttgggtttatcaattcgggcttaccatcgcatcattaaagtggcgcgaaccatagcggatttgcaaggtgaagcgcagatcgctcgtccacatttggccgaggcgttgggctatcgagccatggatcgcttactcaaacagctcagtgcgcagaacgtctagtactctgacctgcagagttcatgtttcattacgatgacaagtttgtataatcacacgctgtttttttactcatctttgaactgagaactatgttggcttacttgctccttacgctgaatgtgaccgtggtggtgttaaattcggcctttcattcgctgctgatctgcttgattgcgttgattaaactgttgctgccgtcagccgcatggaaagcgcaggcgacgcaagcggcgaattgggtgatgtggtcatgggcgagtgtgaacgcttgggttttgcagctttccaaccgcgtggaatgggatattcaaggcggtgaaaccctgactaagcagggatggtatctgctgatttccaatcacttgagttggacggatattgtggtgctgtgttgcgtgtttaaagaccgtatcccaatgccgaaatttttcctcaagcagcaactgctgtatgtgcctttcattggtatggcgtgttgggcgctggatatgccgtttatgcgccgctattcgcgtgagtatctgctgcgccatccgcacaaacgcggccaagatttagcgacgacgcgccgttcgtgcgaaaaattccgcgccgttcctaccactgtcgtgaattatgtggaagggacacgttttaatacacagaagcagcaacgtagcggcgtgggatatcagcatgtattgcagccgaaaaccggtggtattgcctacacgttagctgccatgggtgagcagttcgagcatattattgatgtgactttggcctatccggataaccgtcaacagccgtttcgtgatttattgatgggtcgtatgcagcgcattgtggtgcacattgatttgctaccggtggatgaacaggtacaaggtgattacttcaacgataaacagtttaagcgtcagtttcagctttggctgagcgaggtgtggcagcgtaaagatcagcgattagagcagatttacaaagccgattagcactgagaggctgataaagcgaagggagccattggctccctttgtcttttttctcaataccgaatcatgggttgagattacttcagcgtcagcaggtagttcactaggtcaaaatattcgtcgagggatttgacggactgaccttgtaccaaataacggttgttaacaacaacggcaggtacaccggttaggccgctatcttggaactgtttatcgaaacggcgcaccatagaatccacggcaaagccgttgtaagctgcatcaaatttcgccgcatcaattccttcatctaggaagatttggcgtagttcttgttcatctttcggtggcttacgcagagtgtggatgcggttaaacatcacaggtaccattttatcttccacttccagagcaatcatggttgcgtacgctttgctcatcgcttgacccatgttaccacccatgaaagagacgtggtttttctggaatttcgcgccttcaggcaactgctgcttcaactgagcaatgatgggttcgaaagtgttacagtgcgggcagtagaatgagaaaaactcattgacgactggtgaagaagaggcgggtgtttttaacacttggtagtgttcaccttctttaaattgagccgcataggctgacacgcttaacatcagagttgcaaccagtgcaaacagctttttcatgactttctccattggatttattgtgttggcttaccactgcggctgcaatgataacgggggttcttgtaaagtggcaatctgctctttaaaagcgaggatctgattctcccagtatttcgcgtcattaaaccacggaaatgcgattggaaaagccggatcttgccagcgtttggcgagccatgccatgtagtgcaccatgcgtagaccacgtaaaggctcgattagtttcaattgttgaggattaaaatcgcaaaactcttggtagccttccaaaacgatatctaattggatcagtttgtcttggcgatcaccatgcaacagcatccagagatcttgaatggcagggccgttgcgtgcgtcatccagatcgacaaacatcgggccatcgcgccataaaatattgccggggtggcagtctccgtgcagacggatctgaggctgggtgggtacccaatgctgcttgatttcagcaatcaaaatatcgagatcgtgaaaaaacacccgctgcaaatgggcaggaatgcagtgactgtactccaaggtatgtctgggttgatgtaagtattcatccagcgacagagttgggcggtggagaaagggtttacttgctccgactttgtgaatgcgccccagaaagcggccaacccactctaagtgttcctcattatccacttcgtattggcgaccgcccatgctggtaaacagggcaaaacggtagccttggtagtggtgtagtgtcgcgccattgagtctaagcggcgggacgatcgggatctcttcttgttccagttcgagcgcgaaatcatgctcttcttggatctgctcatcggtccaacgttgtgggcgataaaatttcaccacaaagcggcgacgctcttcatcggtaaactggtagacgcggttttcatagctgttgagtggcaaaaagcctgactcagcacgaatgccgatactttccagcgcgtaccaaatcagatcgggagttaaagcatcaaaatgaaacgtggcttgggtcattgaataaaaagggctcattactgagccctttaccatactggtgagtgtcagagcttttgaataaatcggctctcgacttcaagggtaaattggtggctttcgtcgtgcagtataaactgaattgtcgtgaccgcagagctgagattttctggtttggctccgagcgtcatcgggagattgagtacttcacccggttgcacaaccacactttgtttgccgtaccaagagactggatccaatcctttaaccgacagctgataggtctgtggctgctgggttttgttgatcactttgaggttgtaagtgttttcaatttcgcccgagctgttggttctaaacagttgagtgcgatcgcgaagaacggttaaccccgcgggatccacggcggccacttgagcaaagaacaagccaatcatgaccaagaacaccgctccataaccgagcagtttgggtcgcatcactttggtgtgtttgccagataggcgatgttctgtggtgtagctgatcagccctttcgcgtagcccatacgttccatggtgttgtcacaagcatcaatacacgccccgcagttgatgcactcatactgcaagccgtcacgaatatcgataccggttgggcagacttgcacgcagagatcgcaatcaatacagtcgcctaaaccgagcgctttgggatccgctttgcgagagcgtggcccacgttgttcgccgcgcgcgacatcatagccgacaataaaggtatctttatcgaacatggcggattggaagcgcgcatatgggcacatgtggatacacatgattgagcgcatccagcctgcgttgccgtaagtacaaagggcaaaaaacagtacccaaaacactggccagaacgcggcacttaaagtaaagaagtcgatcaccagtgcgcggatgggcacaaagtagccgacaaaagtgaaaccagtgactaaggcaatcgccaaccaagcgatgtgctttaaggttttacgcgccacgagttctgccgtcatcggactgttgtcttgcttacgtcttttgttggcattgccttcgagtttttcttcaaaccagatgtacataaatgtccacacggtttgcgggcagagataaccacaccagacacggcctaagaaggtagtgataaagaacaggccgaaggcggcgatcataaacagcagcgccaataaggtcagatcttgcgggtagagtgtggttccgaagaagttaaattgctggttgccaatatcaagcaagatggcttgccgatcgccataagagatccaaggaaccaatccaaacaacagcagcagaaaccagccaccataacggcgcagtttctggtaggttcctttactttcacgaacatagatgcgattacttgggttaaagcgatccccgccttgccctttatgggtcttgggattgaacactttgggagtcacatctttaacatcgattttatcctgactcatgacactatccttttcaggcattcggtgtgatttcttttgttcacactcaaatacattgctcattccctcttaaaggctgatgtaagaggggactgatggttttttaggccgtaagtatagcgtcaatcaaacgttcatttctttaaggcaatcaacctttaacaacaaatttccttacaattcttcaccctattaacgacttaataaaaaaagcggctttcgccgcttgctcattttggggttggatctgggctgccgaacgttatacctttcctacttgaagctgcagcggtgtttgctacgctcgttcaccccaatcacatagtttgcctatgctcatggggattcacttacttgccgcctacctgcaactccaagttgtttgggtatatcagcagaattatttgtcagcagaattatttgatgatgcctcgtgcacgtaaaatggcggttttgaaatcatcttcataatcttttttaagtcctgggatcaccgcatcttttgcgctgttacgcatcttgagatggtaaatcagtacatcatcggtcagatcttcgagagcaccttggtaacctgcttcttgagccagtttaagtaagaattgaatcaagttgagctcggaatctttgtgccattcaggctcaagcagttgcagtagttcttctacgcgatgacatttcatgactttctccacaatttttatagtgatttgtggctaaaggtaccaaaagcgctgagcaataccaattcgcgggcaagaaaaaagcgcaggttttactgcgcttttcaattaagctgcctgaaccactttggtttcgggggatgcggtcaacgcatttctttcaaccagcgtgggggctgttgctgtttttttcgcaacgggagccactgcaaaaccactgcggcgacgcattgcactacggtttgtatttgaaaacctgacggttgttgggcgcatgacataacctaactgtcaggcatatccattgccgatgctacaccctggctcattatgagtggctcttgagtacaggacgtaaccgagattcactcttttggcgattgccgatccgaacaatgagacaggaataatgatatgcgttcatatcgcaaatagagtagcaccagttactaaaatgatcgatagttgaccaattttgcgtaacatttattttcaactgcgtggattgagtgagacaagggttagcccttactatgcaattctcacaacaggaggtgtctatgtcgtttatcaagaaaaccctcgccagttttgggattggctctgcgaaagtcgattcggtgttgcagcaggaagtgctctatcccggccaatccgttaaggtcatcatccatgtttatggcggtgcaacagcgcaagtcattgataacatcgagctcaaactttgttgctgttatattgcagaagtggcggatgagcgcggtcagcaacaaggccagccaatgcgccgagttcctcatacctacaccttagccaactggtctttaccgtacgcctttacgattgaggcgggtgaaacgcgtaattttgatatcgaactcagcatcccttggaataccccagtgacgataggggatgccaaagtttggttagagactggactcgatattgcgttagcgctggatcctaccgataaggacattctcaccgtgcgccctgagccgatgatggatggtatttttagtgcgctggaagcacaaggtttgcgtttacgtcaggttgagtgtgagcaagccaaaggcttcgcactgccttttgtgcaagagttcgaatttgtccctaccacggggccatttcaaggtcgctggcgtgaagttgaaatcgtggcttatcgtgatcctgaagccttacagctctggtttgaagtcgatcgttatcaacgaggcgcatccggcatgttggccagcttgctagggcgcggtgagctcaagcgacatctcactttacctgcgcgcacatcaccacaggaagccggggagcaagtgttggcgtttcttgatcgcagctgctgatcacgcggtctgaaattttagctaacacctgtaagctcaatgtgcgatactaaagccaagtttcagactcggattgagtgagtatgtcgaacagttatggctttaaagaagaagtggccaatgcgataagtcatggcgttggccttatcttagggatagttggtttagtgctgctgttggtcaaagcggtggatcagcaagccgatgcattgactattaccagcatgagcatttatggcggcagtatgattgcgctatttttggcttctacgctgtaccacgctatcccttatcagcgtgcaaagcgttggctaaaaacctttgatcactgtgctatttatttactgattgcgggcagttataccccatttttactggtcagtttgcgtacaccactggcggttggtttgatgatagtgatctggtcgctcgcgcttattggcattctgatgaaaattgcttttgtctaccgcttcaaaaagctctctttggtgacgtatctgaccatgggttggctttcgctgatcgtgatttaccagcttgccattcatcttgaggtgggtgggctcactctgctggcggcaggtggacttatctattcactcggggtgattttctacgtcgccaaacggatcccttacaaccatgccatttggcacgcttttgtgctggcgggatgcgcatgccatttcttagccatttatctgtatgtcgagccgatttagctttgacggataagatgggtaaaagaggaaacgcgcatttagcgcgtttcaatctgtttgatggtagcgtgtagtgtgtactgactctgctctgcgaggtttaactccagtggtttgccttccactgaagtgcgcgggcgtaaataggtttccgccattcgtttgatcgactgccaaatcgtcacttcctgttcttcactccacacgccttgtgcatcctgtactcgaatcgcgagacgaaccgcaatcactgactgactactctggttggtgatggcactgctcagcttgagctggccatgctcatagcgcggagcgctcagtaccacatcgacgcctgaatcactgagttgcaaaacagggcgatgatcacccacagtgattgtcacaccactcaatgtcggttgagcgatcaccggtgcagcgagcacgagaggagccagctcgcttgtctgctggggctgagtctcttgtggcacatactgccaagtaaagtcatcgttgagctgaatatagcggccatccttgagctgtaaggtttcgcttgcccaagtggataagctcactatgctggctaccaatatgagttttttcattatgtttccttttaatgacgccagaatgcagggaaaaagagcaccaaaatcgtcagaatttctaaacgtcccatcaacattccaaagctcaagagccatttggcggcatccggtagaggggcaaagttacccgttgggccaatgatgctgcccatacctggacccacgttagccacggcagtgaccgcgccagagatactggtcaccgaatccaatcccattgccgataacgcgccagccagtaccacgatagtgatgaaaaacgtcaagccaaaggcgactacggagcggatgatctcttcattgaccgggcgcttgttatagcgctggataaaaatgccagaagggtggatgaggttcagcagttgctttttgagcagtgccatcgcgatttggaaacgaaagaccttaattccgccagaggtagaacccgagcaagcgccggccatcaataggaaggcaaaaatggttgaggggagcgcgccccacgcggtgaaatcatccagaccatagcccgtggttgtgacgacggagacaatgttaaacatcgaaactcgcagcgcatccaatatcgcgtaatcgtttttgagccacaaccaacctgcgaccagcaaactggagatcataaagagccagaagaagccgcgtacctgctcatctttgagtagggctcgtgcactctgtttgcgcagagcctgcacaaacagtaaaaatggcaggccaccaagaaacataaagagtgtgccaacccagtgcgcgccgtgtgagaagcggttcatcgagctatcactggtcgagtagccgccggtggaaagcgtggtaaaggcgtgattaatcgcttcaaacggcgtcatacctgtggcgatatagctcaaaaaacagagcccagtcaaaaccagatacaccgccacaatgtttttcgcgacggttttcgcgcgcgggctgcttttatccgaccaatcagacgattcggtttggaacagcttcatccccccaacattgagcatcggcaacaccgctaccgccatcacgataaagcccacgccacctaaccattgcaaaatggagcgccacaacaaaatactgggcggcatatcatctaagccactgagtaccgtggagcctgtggtggtaaggccggacatggtttcaaaataggcatcggtaaagctgatgtggttaataaacacaaaaggcagagcagcaaatgcgctggcaatcgtccataccaagctggtgatcaggaacatatcacgtacgttgagccgaaaatgttcagtgcgaccgatacttaagcagagaaacgccaccagatgggtaatgatgacggcttgcgcgaaatcgagaaaaccgccgctgccagtaaaaaatgccactagagtcggcacgtacatgaatagggctagcttagacagcactagcccgatgataaacgtaattgggcgtaagttgagcatagcgccaacctttacaagaagaatgggctcggctggaatagcgtttccacgtcgggcacatattttttatcgaccaagaacatgacgacgtgatcgtcttgctcgatgacagtgcggtcatgggcaatcagcacttcttcgccccgcacaatagcgccaattgtcgtgcccggaggcagtttaatatcgcccaccgctcgtcctactaccttagaggttgattcatcgccgtgggcaatcgcttcaatggcttctgccgctccacggcgtaatgaagagacgttgacaatatcggcgcggcgcacgtgagtgagtagcgcagaaatggtcgcttgctgcggggagatcgctacatcaatcacaccgccttggactaaatcgacatagccgctgcgttggataagcaccatggctttcttggctcccatgcgtttggcaagcatggccgacatgatgttggtttcatcttcattggtgagggcgataaacacatcgacctgatcgatattctcttccgacagcagctcttggtccgcggcatctccacaaaagacgatggtattttccaactgttcagataactgttccgcacgttggtaattatgttcaatcagcttaacgctgtaagtttgctctaggcgtttagcgaggctggcacctatgttaccgccgccgacaatcatgatccgacgatacggtttttcaaggcgctgcaactcactcatcaccgagcgaatatggttactcgcggcgacgaaaaacacttcatcatccgcttcaataatggtggtgccttgcggacgaattgggcgtccctgacggaaaatcgctgccacgcgagtatcgatgtgcggcatgtgatcgcgtagggcagaaagggcgttaccaaccagtggaccaccgtaatacgctttaacggccaccaagctgactttttcttcggcgaaactcaccacttgcagcgcgcccggatactggatcaagcgctcgatatagctggtgaccagttcttccggtgcaatcaggtgatcgaccgggaccgcgccagattgaaacagcgcttctttttcagcgagatattgtggagagcggatacgcgcaatccggttgggcgtgttaaacagagtaaaggcgacctgacaagcggccatgttggtttcatcggtattggtgaccgcgaccagcatgtcagcatcttgtgcgccagcttcgcgcagcacatcagggtggctggcgtgaccattgactacacgcaaatcatatttatcttgtaaatcgcgcagtcggtcagcgtttttatcgaccacagtaatgtcgttgttttcgcctaccaagttttcagcgagcgtaccgccgacttgtcctgcaccaagaatgatgattttcataacttgttctctttgtttgctcacgcccaaggtgagttgtggctcaccttggttgaccgaatcagtgttgtttgcttaatacggcgtaatagaaaccgtccatcgcttcctctccgggaaggatttggcggccgggctgcgcgggctcggaacccactaagcgcgcatctggcgtgcgttcaaggaacgctttgacctgtaggcggttttcttgtggtgtgatcgagcacgttgcgtacaccaaactaccaccgggtttgagttgttgccacatcgcatccaaaatttcgcgctgtagctcggctaatgccgcgatatcgtctgcgcggcgcagccatttgatgtcgggatggcggcgaatcacgccggtcgccgagcaaggtgcatccagcaagatgcgatcaaactgttcgccttgccaccactgttgcgggtaacgcgcatcgccacaaatcacttgcgcagtgagctctaaacgctgcaggttttctcgcacgcgtttgaggcgagtttcatcacaatcaatcgcaacgacttggctctctggtgtgcgctccaagatgtgcgcagttttgccaccaggggcagcgcagcaatctaaaatcagctctcctgcttgcggtgcaaggtaagtcagtgctaactgcgcagcggcatcttgtactgaaacccaaccttcagcgaaacccggcagttggtgtacatcgcaaggcgtttctaagcacagcgcatcttcggcttgcgcatgaggcgtagtgacgatgccagcttgttcgagcagggcttgatactcagcacgagtatggtgttgatgattgacgcgtagccacatcggcgctttgctgttgttggcttcaacaatttgttgccactgctctgggtagctctctttgagcaatttcaataaccagcccggatggccgtagcgccctgcgtcatggctggtggcttgagcatctaagccttcttggtcacgctgatagttacgcagcaccgcattgatcaagccgcgcagacgagggcctttcaaatcttgcgcgccttcgacggtttcccctaccgcagcatgtgcgggaatgcgcataaagctcagttggtataagccgacgaggatcaggaagtggaatacgcgttgtttgcctttcaacggttttcccatcagagcttggctgatggattccaaacgcggcaattggcgcaaaacgccatagcagatctcttgcagcagggcgtgatcacgtgggcgaatttgctgctgagccgcaggcaaagcattggacagtgagtgccctaaatcaaccacttggtaaagagccgacgcagcagcggcgcgaacattcataataaaacctaaacaaaaagccaaaccctagccatccataggctagggttcaggattaactgagttgggaaccgacactaaaccagtcggcacgcgcattgagaatatcttgtactggcaaggctttcttgcccggaatttgcaggctttcgagcactagtacatcttgcccggttgccacgtaaatcccgctcttatctgcttggataatggtacccggagtttgagttactgctcgtgtttcaacacgcgcttgccaaaccttaatgctgttttctgctacttcaaaatggctcatcggccaaggattaaaggcacgaatacagcgctcaatatgtgtcgctgcatcactccagttaatacgcgcttcttctttgctgagtttatgcgcgtagttcgccaatccatcatcttgtttgaccgcaaccgctgtgccttgagcgatatcttgtaagcactcgagcagcgcttgtggaccaagttctgccagtttgtcgtacatcgaggcactggtgtcgctcgcttcaatcggcagcgtcgcgattttcagcatatcgcccgtatcaaggccgacatccatctgcatgatggtgacgccagtttcgctatcacccgcccaaatggaacgctggatcggcgcagcaccccgccaacgcggcagaatcgaaccgtgcacattaatacagccaagtttaggtgtatccaaaactactttaggcagtagcaagccgtaagccacgaccaccattaaatcggcgttgagtgcggcaagctgttgtttagactcgtctgatttaaagttctctggctgataaaccggaacgttgtgctcaagtgcaagggttttgactgggctggcggtgagttttttgccgcgccccgctgggcgctccggttgggtgtagaccgcaataatctcatgctccgaagacaataacgccgccaagtgacgggcggcgaaatccggagtacctgcaaagacaatacgtagtgattggctcaaggttacctcacagtaatttattttttctcattgaagcgtttgattttctctagcttctctttgatgcggttgcgtttgagtggtgacagatagtcaacaaacagtttgcccgcgaggtgatcgagttcgtgctgtacacagatagccagtaggtcatctgcatcaaactggtactcttgaccattgcgatccagcgcttttacggtcacttctgcggcgcgaggcactaaagcccgcgcacccgggacggacaaacagccttcttcaatgccatcttcaccgcgcttttcgatgatctctgggttaatcaacaccataggctgatcgcgagtttcagaaatatcgatcaccacgatacgttggtgaatatcgacttgggtcgccgctaaaccgatgccttcttcggcatacatggtttccaacatatcatcgacgatttgttggatttctggggtgacttgttcgaccggtttcgcaacggtacgcagtcgatcatctgggaatgttaatacttgcaatacagacatatacactcgaaatgttgaactgtgccgaaacagcttaatgcgtgttggctcaattctagacattttatgacccaaatgacagcatccggacgtgatttctccgaaacccagtcattttttcgaccaaggaagcaaggtcatggcacgattaacccgttatattacctacgctttattgcctttcactctgctcagtggacaggtgaccgccgatgagcaaacgccgctggcactcaaaccaaatgcaccgaccacctataccgtggtgaaaggtgacaccttgtgggatatttccgctttgtatctcgacagtccatggctgtggccaagactttggcaagtgaacccagaaattgataacccacatttgatctaccccggtgataaattgacgctgttttggcgtgatgggcaacccgaactcagtctaaaaccgatgcgcaaactgagcccgcaagtgcgtgtgttggagaaacaagctgttccgactgtgcaagaaggcttggtgctgccttatttacaatctgaccgtttgatggcgaaaaccgccttgcaaggtagcgtgcgtgtgattggctccagtgaggggcgtcaatatctcaccaagcaagatcagctttacatctccggtgtacacagcgagaaaaagtgggggatttatcgcgaggtagcacagtatcaacgtgatgatgaagtcatggtggcgctgcgtttagtggcggtgggtgaattggcgatgactgggggcaactttagtggactaagcttgctagagcaaaatcaagagattttagccaatgatattgctttgccagaagtcgatcttgaggagcgccaactgtcgacaaccttctatccgcagccagcgcctgcagggagtgaagctcgcattctgggttcgcttgaagggagtcaatacgccggacagaatcaagtggtggtgattgaccaaggccgcagtgatggcgtcgcgcaaggcagtatgtttgaactgtatcaagccgcagtccaagtcaaagctaagcaagattcgtctactttcctgtctgagcgttcgaacacggacgtacagttaccaagtgtaaaagtgggcgctttgatggtgattcgcccttatgagcgttttagcttggcactgattactaacagttcggcaccgatcagtgctgaagtgcacgcactgtctccgcaggcagagcctcaaaccgagcagccagatgtagtgcaattgtctgaacaaatcgatttggttgatgatgccagttaatgaaagatcaggatttagcggcatggttggcgctctgttttactcctaaactaggcagcaaaaccatttctcacctgcttgcgacccgtttgccagcccagttgcaaagttttacgcctaagcaatggttggcctgcgggcttaagcccgaacaactggtgtttttaaccactcaagcggctaaacaagccgagcagtgtttgcaatggcgatcagcagccaataaccgctatatcgtcactcctcattgcccgctttaccctcgtttattgaaagagattaactcatcgcctcccgtcctgtttattgaaggaatatgggaagcggtgcatgaccctgcggtggctatcgtcggtagccgcaatgccagtgttgatgggcggcagatcgctcgccagtttgccactgagctcgcgcagtcaggtttagtggtcaccagtggtttagcgcttggtattgatggctatgcgcacgatggcgctttgcaagcacaagggcaaaccgtagcagtattaggttcagggctggcgcaggtttaccccaaacagcatcaagggttagcggagcgaatcatcgcccaaggggccttggtttctgagtttgcccctcacacaccgcctaaagccgatcactttccgcgccgtaaccgaattatcagcggcttatcgctcggtgttgtggtggtagaagctgcggagaaaagcggctcactcatcactgcacgctacgcggctgagcaagggcgtgaggtctttgtggttcccggatcaatttttaatgccgccagccaaggtagcaaccaattgattcgccaaggcgcttgtttggtgcaaagtgtgcaacaaattcatcaagagctcaaaaatgcgctgacttggtcactctctgaacaagttccttatcaagcaacacttttttctgctgtacagagcgatgaagaattgccatttcccgagctgttagctaacgtaggaatagaagctacacctattgatattctcgcaagccggacccagataccggtgcaagatatcatgatgcagctcttggagcttgagctccttgggcatgtggttgcagtacctggtggctatattagaaaggggagaggctagctatgatgatggatattttgatgtatctgttcgaaacctacgtccatagcgatgcagatttgcaagtggatcaggaccagctggaagatgaactgctgcgtgctgggtttcaccaaaaagacatctacaaggccctccactggttggaagagctggcggctttgcaacaaaccgatgcacaaactgcaattgcgaaaagtgcacccacttcaatgcgtatttacgcgccggaagagattgaacgactggatctcgaatcgcgtggtttcctgctgtttcttgaacacatcaatgtgctgaccccagaaactcgtgaaatggtgatcgaccgtgtcatgggattagaaaccgatgagtttgagcttgatgacctgaaatggatcatcctgatggtgctgttcaatgtcccgggtaatgaaaatgcttacacagtgatggaagagctgctgtacagcaaagaacaaggcattttgcattaagcgtgtgatgtgtctatgagtcgtaaaattgacccgcaactgtttgccgctcatgagcatgcgctgcaatcttccccttgtccgcaatgtggcgcagcattacaactgcgccacggcaaacatggtccttttttaggttgcactgcatacccagagtgtgactacatcaaacctctgcatcaaaatgatgggcatatcatcaaagaactcggtgtgccttgccctgaatgtggacatgaactggtgctgcgccaaggtcgttacgggatgtttattggctgtagccactacccgcagtgccaccatatcgagtcgatggattccccttcgcaagaggaaacatcgccagatatcctttgcccggaatgcggcaaaggccaccttatcgaacgcaaatctcgcttcggtaaactgttttatgcgtgtgatgcgtatcctaagtgtaagtttgctttaaatagtaaaccgattgctcaggcttgtgctcagtgtggctttacggtgatggtggaaaagaaaagtgcagcaggcatgcgctatcaatgcgctaatcgtcaatgtgggcatattcaggaatgctagcttcatcatgctcatcgcatacaaagttaaagccgcgttagacgcggctttattgcattagtggggtatggattaaggctgaatttcctttgctacggcgtgtacggcaggaaaagccttttcatctaacacagtcgctaattggcataatttgcgttgcaactcaccactgtaatcggcggtcacattgatatgccccatcttgcgtcctgagcgcttggccttgccgtaccaatgtacgtggcagccttccagtgccaatacttctgcgggcagctgatcttcaccaagaatattaatcatcgcggtctcacgaaccagtttggtgctacccagcggtaagccacacactgcgcgtaagtggttttcgaactgacaggtttccgcaccttgctgagtccagtgaccggagttatgaactcgtggtgcaatttcattgaccagtaactggccttgtacttcaaaaaactccagcgctaatacaccgacataattgagctgctcggctaccgctttaaacatggctttcgcttgagtttgtagcgcaggagcatcaatggcggtagaaaggctcaacacaccttgggtatgaacgttctccgctaaaggatacaccacaacatcgccgactaggttacgtgcaccgaccagtgacacttcgcgatcaaaagcgacaaattcttctgccacaattgcttgttcggggttggctgccagatattgcgcaagttcttgccaaaccgattcgatctgcgttggttctttcaagcgccattggccttttccatcgtagcctccgagtgcacttttcagcaccataggcaatccaatctcggcgatggctgaggttaggtcgtctcggctgcggatcatcgtataacgtgcattcgccacttgggcgcgatccagcaaggctttttctaaacgacgatcgccgccagctttgatagcttcagcgcttgggtaaagtttgccactgcgtgcacagagatcgaggatcggatgcggaatgtgttcaaactcagcggtgatcacatcgacttgttcaatcgcttgctccaatccatgcccaagcacagtttgcgttaaggggtgcacaatgttttcgctacccacatcaaaagcgatcgtttcaatattgagcggtgctccggcgagcgacatcatgcgcgccagctgaccagcgccgagaaccaacacacgcatctgttactcctcagccggatttgggttatccaacacagattgagtctgcttagcgcggaaagcttccactttactcatcacttctgggttatgaatgccgatgatttgtgcggcaagtaatcctgcattagcggcaccagcttcaccaatggcgagcgtacccaccgcaatgccttttggcatctgcacaatggagtataacgagtcgagcccagacagagcgcgagattgaacgggcacgcctaacactggcaagctagtgaatgcggcggtcattccgggaagatgcgcagcgccgcccgctccagcgatgatcacttgtaaaccgcgttctttggcgctagaggcatagtcggccaaaagatgaggagttcggtgcgcagaaaccactttagtctcgtaagccacaccaaactggtcaagcatctctgctgcgtgtttcatggttggccagtctgacttggaacccatgataataccgactgtcatctcaaactccttcagtgttatttatcggacaagcaagcccgcttgcggcgcattatacggggatttttttctcaagcaaacgtttgctttttctggttgatgagaagaactggtcaattgctccacgatttgtacactgagcacaaatgaaagaggagtggctctggtggagaatctacaacaggcggtggatgcgctgcgcaaaggttgcgttattgcctatccaaccgaaggggtgtttggtttggggtgtgatccggataaccaaaccgctatgctgcgcttattggcgatcaagcagcgccccgtggaaaaaggggtgatcttaattgccgctagctatgcgcagttgcgcccttatgtcgatgaaacgcaattaaccgcagagcaactgacacaagtgctggcttcatggcccgcgccactgacttgggtcatgccagccagcggtgatacgccaagctgggttcgtggtcagtttgataccgttgccgtgcgtgtttcggatcatccggtcgttcagaagttatgtctcgcctttgggaagccactgacgtcaaccagtgctaatctaagtggccagcccgcgtgcgtaactcaacaagaagtcatggttcagctaggcaatcagattgctgtggtagtagaagggaagaccagtggccgtcatggaccgagcgaaattcgtgatgctcgcagcttacaagtgttaagacagggataaccctgcgcaggagagaatgtggagtcgatagtcgataaacaagcagtgaagcactttttactgcagctacaagataagatttgccaacaattggaagccacagatggccaagcgcaatttattgaagatgcgtggcagcgtgaaccgggtgagaaactgggtggtggtggccgtacgcgagtcatgcgtgagggcgctgttttcgaacagggtggcgtgaacttttcccatgtatttggtgagcagatgcctgcctctgcgacggcccatcgtccagaattggcaggtcgccgctttgaagccatgggcgtttctctggtcatgcacccgaaaaatccgtatgttccgacctctcatgccaatgtgcgcttttttattgctgaaaaagagggcgaagctccgatctggtggtttggtggtggttttgaccttacgccgttttatccctttgttgaggatggccagcactggcatcaaactgctaaaaatatctgcgccccttttgggtcagaaatctataacgaacataaagcatggtgtgatcgctatttctacttaccacaccgcaatgaaacacgcggcatcggcggattgttttttgatgatctcaatgaatggtcattcgagcaatgtttcgcttatatgcaggcggtcggcgaaggttatacccaagcttatgtgccgattgtcgaaaaacgcaaaaacacgccctttacagagcgcgagcgccaatttcaactctatcgtcgcggtcgatacgttgaatttaacttggtgttggatcgcggcacgctgtttggccttcaaaccggtgggcgtaccgaatcaatcttgatgtcgatgcctcccttagcgcgttgggaatacgcatatcaaccgcaagcaggaacgccagaagccaagctaagcgagtttttagtgcctcgtgaatggtgacaggcaaggttctgagtgatagggtcgcgcaagtgacccttttgattgtttaggcaaggatatggcttctcaaatcgatcagtatgccgtttttggtaaccccattaatcacagtaaatccccttttattcatacgctgtttgcacgacaaactcagcagtccatgatctataccgcacagtgcgtgccagtggatgggtttactgaggcggcgaaacatttttttgcgcaaggtggacgaggttgtaatgttaccgtgccatttaaagaggaggcgtaccgctttgccgatcgcttaacggagcgcgcgcgtttagccggtgcggtaaacacgttaaaaaagctggatgatggcgaaatactcggagacaacaccgatggtgaaggcttagtgcaagatctactcgcgcagcaagtgctactgaaaggcgcgacgattttgttgattggtgctggtggtgcggcgcgtggcgtgctcaagccgttattagatcagcagccggcctctattaccgtcacgaatcgtacctttgcgaaagcggagcagttggctgagcttgtggccgcttatggtgaggtaaaggcgcaagcgttcgaacagcttaaacaaagttatgatgtgatcatcaactcgacctctgccagtctcgatggcgaattgcctgcgattgatccggtgatcttttcatctcgctccgtctgctatgacatgatgtatggcaaaggctataccgtgtttaatcaatgggcgcgacaacatggctgcgcgcaagcgatcgatggcttaggcatgttagtgggacaagcggctgaaagttttatgctatggcgtggtttacgtccgggcacgaaacaaattttgcgtgaactgcgtaaaaatctagaaggtgcgctatgaaccaatccatcttgtttcccgatttacagcattgggatgaggcaaaacaagctgttgtattttttgctcagcaaaacggagcattaatcgaatgtcttgtggcgcgacaagttctacaagagctctcaggtgaagctttagcagaatcgcaacacgtgatgacggccttcagtgagtggcgttttgacctagaggaactcgccgaacaggcgattgaaaacgaaatgtttaactctctaggccaaattgagatcactcgcgaacggttttaacgtcattcagatagtcattcttactctgaacataattactggacgatttaacgagaaaagcacgctccttatcattgagaggacgtgcttgcttgaccgggctacccatgtacagaaagccactttcgagccttttcccgggcggaactaaacttcccgcaccgatcatgacatcattttcaatcaccgccccgtctaacacgatagaccccatgccgacgagaactcgatcatgaatggtgcagccgtgcagcataaccttatggccaatggtcacatcatccccaatgcataacggatacccattcgggttttcggcatttttgtgagtgacatgcagtaccgaaccatcttgaatattggtgcgtttaccaatccgaatatggttaacatcgccccgtgctgccactaaaggccaaatactggcatcgtcgcccagttctatatcacccacaagcacagcactgctatctacataaaccccttcaccaagcttgggcactatgcctttgtagctacgaattgaactcatcatttcacccttttataagcaagtggtaggtatagtagatggcttaatcattaacaaatagcctgttctgcctaaaacatcaccaagtgctcgaaaactttaaaaaacttctaaaaagtacttgccaatataactaggttctctataatccgccctcactgatacggcagacgcagtaagcgttagcagtgattcagctcggtgttttaggtcgcgaaatcgccaacgaaaataaactgaaaaaagtgtttgacacaacagtttatctcgctaaaatggccgcctcttctgaagcagactgcaaagaagaacgctctttaacaatataaaccaatcaatctctgtgtgggcactcgttgatgataatcaaaaaagatttatcaatgaactgagtgaccatttgaatgagcaatcattcagcacagtcaattcaacattacttcgctttttattaagcaaagaatgtaatcagtattcannnnnnnnnnnnnnnnnnnnnnnnnnnnnnnnnnnnnnnnnnnnnnnnnccattggaaacgatggctaataccgcataacctcgcaagagcaaagcaggggaccttcgggccttgcgctaccggatatgcccaggtgggattagctagttggtgaggtaagggctcaccaaggcgacgatcctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagttaataccttaatcatttgacgttacctacagaagaagcaccggctaactccgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcaaatgaattgacgggggcccgcacaagcggtggagcatgtggtttaattcgatgcaacgcgaagaaaccttacctactcttgacatccagagaatctagcggagacgctggagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttaacgagtagggctacacacgtgctacaatggcgtatacagaggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacacgatggttatcgtgatgagtgtccacacagattgattcggtttagatttgagcattaagtgggctatagctcagctgggagagcgcttgcatggcatgcaagaggtctgcggttcgatcccgcatagctccaccatctttaagcgttttcgctgagaatgtttaaaaatggttttcatcagaaaatcttgctctttaacaatttggaaagctgacaaaacaacaatttattgttgtttgtaaagttctcaatgtttatcgaaagataaacaccaacaacacattcaagtgtgcttggtatcgaataagacttcggtcttgttcaaatttgagtccggcaaaatctgtctcgcactcatgtaaattaaacgcgagacaacttaggttgtttaaacagcaacccgaaactccttcgggttgtatggttaagtgactaagcgtacacggtggatgcctgggcagtcagaggcgatgaaggacgtactaacttgcgataagcgcagataaggcagtaagagccgtttgagtctgcgatttccgaatggggaaacccaactgcataagcagttactgttaactgaatacataggttaacagagcaaaccgggggaactgaaacatctaagtaccccgaggagaagaaatcaaccgagattccggtagtagcggcgagcgaacctggattagcccttaagcactcggtgaagtaggtgaacaagctggaaagcttggcgatacagggtgatagccccgtaaccgacgcttcatcgagcgtgaaatcgagtaggacgggacacgtgatatcctgtctgaatatgggggaccatcctccaaggctaaatactcctgactgaccgatagtgaaccagtaccgtgagggaaaggcgaaaagaacccctgtgaggggagtgaaatagaacctgaaaccgtgtacgtacaagcagtaggagcaccttcgtggtgtgactgcgtaccttttgtataatgggtcagcgacttatattcagtggcaaggttaaccgtataggggagccgtagcgaaagcgagtcttaactgggcgctcagtctctggatatagacccgaaaccgggtgatctagccatgggcaggttgaaggttgagtaacatcaactggaggaccgaaccgactaatgttgaaaaattagcggatgacttgtggctaggggtgaaaggccaatcaaactcggagatagctggttctccccgaaagctatttaggtagcgcctcggacgaatactactgggggtagagcactgttaaggctagggggtcatcccgacttaccaaccctttgcaaactccgaataccagtaagtactatccgggagacacacggcgggtgctaacgtccgtcgtggagagggaaacaacccagaccgccagctaaggtcccaaagtattgctaagtgggaaacgatgtgggaaggctcagacagctaggatgttggcttagaagcagccatcatttaaagaaagcgtaatagctcactagtcgagtcggcctgcgcggaagatgtaacggggctaagcaatacaccgaagctgcggcaatgtcttttagacattgggtaggggagcgttctgtaagccgttgaaggtgaatcgtaaggtttgctggaggtatcagaagtgcgaatgctgacatgagtaacgacaaagggggtgaaaaacctcctcgccggaagaccaagggttcctgtccaacgttaatcggggcagggtgagtcgacccctaaggtgaggccgaaaggcgtaatcgatgggaaacgggttaatattcccgtacttctgactattgcgatggggggacggagaaggctaggtgggccaggcgacggttgtcctggttcaagtgcgtaggcttgagagttaggtaaatccggctctctctaaggctgagacacgacgtcgagctactacggtagtgaagtcattgatgccatgcttccaggaaaagcctctaagcttcagatagtcaggaatcgtaccccaaaccgacacaggtggtcgggtagagaataccaaggcgcttgagagaactcgggtgaaggaactaggcaaaatggtaccgtaacttcgggagaaggtacgctcttgatggtgaagtccctcgcggatggagctgacgagagtcgcagataccaggtggctgcaactgtttattaaaaacacagcactgtgcaaaatcgcaagatgacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccacgctgtctccacccgagactcagtgaaattgaaatcgctgtgaagatgcagtgtacccgcggctagacggaaagaccccgtgaacctttactacagcttggcactgaacattgaacctacatgtgtaggataggtgggaggctatgaagacgtgacgccagttgcgttggagccgtccttgaaataccacccttgtatgtttgatgttctaacttagacccattatctgggttgaggacagtgcctggtgggtagtttgactggggcggtctcctcccaaagagtaacggaggagcacgaaggtgggctaatcacggttggacatcgtgaggttagtgcaatggcataagcccgcttaactgcgagaatgacggttcgagcaggtgcgaaagcaggtcatagtgatccggtggttctgtatggaagggccatcgctcaacggataaaaggtactccggggataacaggctgataccgcccaagagttcatatcgacggcggtgtttggcacctcgatgtcggctcatcacatcctggggctgaagtcggtcccaagggtatggctgttcgccatttaaagtggtacgcgagctgggtttagaacgtcgtgagacagttcggtccctatctgccgtgggcgttggaagattgaagggggctgctcctagtacgagaggaccggagtggacgaacctctggtgttcgggttgtgtcgccagacgcattgcccggtagctaagttcggaattgataagcgctgaaagcatctaagcgcgaagcgagccctgagatgagtcttccctgacagtttaactgtcctaaagggttgttcgagactagaacgttgataggcagggtgtgtaagcgttgtgaggcgttgagctaacctgtactaattgcccgtgaggcttaaccatacaacacccaaggggttttgtagtggactcaaagctaagcgcataagaatgtgtgtgagaacgaagacagctttccagaattgttggttatcactttttaagaaaagtgaaatcaaaaacagaatttgcttggcgaccatagcgttttggacccacctgattccatcccgaactcagaagtgaaacgaaacagcgtcgatggtagtgtggggtctccccatgtgagagtagaacatcgccaggcttttaatttggtctaaccagacagcggagcggtagttcagtcggttagaataccggcctgtcacgccgggggtcgcgggttcgagtcccgtccgctccgccacttattcgagcttaagctcaaaaaactacaggggtgtagctccaattggcagagcagcggattccaaatccgcgtgttgggagttcgaatctctccacccctgccatatatcgaacctcagcagaaatgctgaggtttttctttacctgccatttaattaatctcgtcctaagagtttttgtgattaagtgacgcatgtaacttttctatttttctccttattgttaacggcaatccgccacattgtttttgctcaatctattatttcgttgaagttttgcgctttataccgaggagtgtttagaataccctcttagttggtagataaaggaatcggcatgtcattcgcgatattgggttttattgctttaggcggcgcggttggtgcttgcgctcgtttcttagtgtccgaaatatgcgtcactttatttgggcgtggtttcccgattggaacactgaccgttaatgtggtggggtcatttattatgggggttttgatcgcttgtgttgaaaatgagtggttaagcccttacccatggaaacaagtgattggccttggttttctcggagcattaacgactttctcgacgttttctatggataacgtgcttttaatgcagcagggcgctttttttaaaatgggggcgaatgtactgttgaatgtcattttaagtatttctgctgcgtggattggttttcactggttaatgaaaagttgatcaatgaaacagccattttacttggttaacgaataagctttatctataatgcttccacttgtcggagtgccattgggctgagaccgtttattcgggatccgttgaacctgatcaggttaatacctgcgaagggaacaagagaagactctcttaggtgacctattgttattaatagcgtacttacctgtcgactcatctctcatagcatctttccgtcaagcatttctccctcttattaaaaaggaaatgctatgtcgaaccgtaaacaagcaagactggaagccaagcgctttattgataccctttctgttgaaccctatcctaactctcaaaaatcttacctattaggctctcgccctgatattcgggtgcctgtcagagaaattactctcagcgatactttggtcggtggcagtaaagatgcacccatctttgagcccaatgagcctatctgtgtgtatgacacatctggcgtctatactgacccttcacatgatattgatctctacaaggggcttcctaagctcagagaggagtggattgaagagcgtcgagatacgcacattctgcctagtatgagctctcatttcgcccgtgaacgcttagcggatgaaactctagatgaactgcgttatggccatttaccgcgaattcgccgagcgatgggccagcatcgagtcactcagttacattacgcacggcagggaatcattacgccggaaatggagtttgtggcgatccgtgaaaactctcgtcgtcttgctcatcaagatccaagtctacttcagcagcatgctgggcagaattttggtgctcatttacccgatctgattactcctgagtttgtgcgtcgtgagattgcagaagggcgcgccatcatcccatgcaatattaatcatcctgaatctgaacccatgattattggccgcaatttcttggttaaggtgaatgccaatatcggtaactcttctgttagctcttctattgaagaagaagtcgagaagttagtttgggcgacccgctggggcgcagatactgtgatggatctgtcgacagggcgaaatatccatgaaacccgcgagtggatcttacgtaatagccccgtgccaattggtactgtacctatgtatcaggcgctggaaaaagtgaatggtgtagcagaaaacctcacatgggaagtgatgcgcgataccttactagagcaagctgagcaaggtgtggactattttacaattcatgcgggcttgctattgcgttatgtgccgatgacagccaagcgcgtaacgggcatcgtttctcgtggcggctcgattattgcgaaatggtgtctttctcaccatcaagagaatttcctttatacccattttcgcgaaatctgtgagatttgtgcgcaatatgatgtggctctatctctaggggatggacttcgtcctggctcgattgctgatgctaacgatgaagcgcaatttgctgagttacgtacccttggtgagctaacccaaatagcttgggaatatgatgtgcaggtcatgattgaagggccgggtcatgtacctatgcacttaattaaagccaatatggatgagcagcttaagcattgtcatgaggcgccattctatacccttggtccattaactaccgatattgccccgggttatgatcacattacctccggtatcggtgcggccatgattggttggtttggctgcgccatgctctgctatgtcacacctaaagaacatttggggctgccaaacaaagaagatgtcaaaacaggattgattacttataagttagcggctcatgcagcagatttggcgaaagggcatccgggagcgcaaattcgtgataatgcattatcaaaagcacgttttgagtttcgttgggaagaccagttcaatcttgcgcttgatcccgtcacagcacgcgctttccatgatgagaccctaccgcaggaatcgggcaaagtcgcgcacttttgctctatgtgtggccccaaattctgctcgatgaagatctcgcaagaggtcagggattacgcaaataaccagacattagacaccaccgtcattgacttggttatgcctgcagaatctatacagctggcgatgcaagataagtctcgtgagtttttagcctcaggtgctgaactctatcatcctttggtgaaagagccgatcgaggagtaagtcatggtacgtttggtttttccacgtcacctatcagccttaatcggtcacgtgcaatacgcactgttgcaagccaaggaacaaggggtcgctattcagcatatccgtttggatgtgggctctgaggctcagtttattttagagaagagtgaagagtctttgcgaattggcagtagtttgtgctctcaaaaggagggttttgagccttgcgactactacctagactatgtgtctgaaaaccgagtgttacccgaggcaatgatgtgtaacgctcgctgcacggtgactgtaggtcttcatgatgaatatggttttacgctggataagtggcagtatgggcatgctgcagagcaacttattgtttatccatcagagaaccatcgattaaatagtaaggtaaatcagcatcttgcttgggttttagctacgttgaccttagatttttcgattggagatggtttgtgcattgcaagagcggcaatcactcaaggggatagcgtttcacgtgaaacatggccaacgcaattcgagcgtttccctgcagtgcaatctaacattcgctctctatctacccaagtatttctaaccaccagagcatttccaacgattgataaagcaaaatttaatctctatcccgtagtggatgatgtgaattggattgagcatcttctgaagctcggtgttagaacggttcagctgcgaattaaagatcctaagcagggtgatttggaagcacagattatccgagccatcgcgttaggtcgtgaattcaacgcacaggtttttataaatgatcattggcaattagccattaagcatcaggcttatggtgtgcaccttggtcaagaggatttgacgagtgcgaatttaaccgagctattagatgcaggtattcgattggggctttcgacgcatggttattatgagttactgatagccgcaggaatacagcctagctacatcgcccttgggcacatttttcccacgaccactaaacagatgccatcaaaaccacaagggctagtgcgattggccgcctatcagcggttggttaatcaaatgccttaccaaggacaacatggcattccaacggtggcgattggtggtattgattgcagaaacattcgcgatgttctcgattgtggcgtcacggcggttgcagtggtgcgggctattaccgagtcaccggatcctagccttgcagtacaagcgttgagttctgcttttgccgattttgtagatgcggagtacaagttgatgccagccagcgagtcatgcgagccactcagttacttggctatggaggtagcggatgctcacagataaacagtttcttcgctatcaaaggcagatcagccttgctgagcttggagaggaagggcagcaaaaactgcttaattcacgtgtgttgatagttggctgcggggggcttggtaatgtggtggccccttacttggttggtgcaggtgttggacaagtgattatcgcggatagtgataggctggagttacacaacttacaccgtcagatttgctatcacgaggcacaaattggtcacaataaagccgagcttcttgctcggtacttgcgtgaactcaattcagaagtacgagtgcgggtgattgctcgggaagtagatgagctgatcctgaacttagaaatcaaccaagtggatttggtgttggattgtagtgataaccttccaacccgccacgcaattaatcgagcctgttatgcagcgcagcggccactcatcagcggtgccgtcattgggtgggaagggcatctcatggcgtttgactatcgccaatctacaccttgctatcagtgtgtcgtaccggatatggcagagcgccaacgctgcagtgaccgaggcgttattggccctgttgtcggtatgattggtaacggacaagccttaatcgcactgcatgctctgatggggagcgcccattttcctgctaaccaattactgcgctttgacggtaaatctatgaactggcagagcttacagcttcatccagataaggtttgcccagtttgcagcgtatcgtcacctgcacaaccgaaggagccgcaaccgtgctaatgactatctacttgaatcagcaagctatccagactgatatttctagctcattattccatttacatgcgcagctcagcctgcctagccaaggttgcgtcttcagtctcaatgggcaggttgtcccaagaagtgaatggcaacacaccaagcttaattcaggggatgagatttcccttttccaagcgatagcaggaggctaaatcagatgctcaagattgcagataaaacgtttcaatccagactgtttactgggactggaaaattctctaatcgccatgtcatggctgaagcattggccgcctcaggttcagagttggtgaccatggcgttaaagcggattgatttggctcagcgcgacgatgacattcttgcgccgctactcagtatgcagatgaatctcttacctaacacatctggagccaaaaatgctgctgatgcggtgtatgccgccgagctagcccgagaagccttagccacgaactggcttaagttggagattcatcctgatcccaaatatctaatgcccgatcccatcgaaaccctgcttgcggcagaacaattggtgaagcaaggttttattgtgttgccgtattgtcatgctgaccctgtcttgtgcaaaagattggaagaggttggctgcgctgcggttatgcccctcggttcaccgattggcagcaatcaaggcttggcgtcgaaaacctttcttgaaatcatcattgaccaagccaaggtgccggtcattgtcgatgcggggattgggtcgccatccgatgctgcgcaagcgatggagcttggcgccgacgctgtgttagtgaataccgctattgccgcggcgcatgaccccatcgctatggcaaaagcctttaagctagcggtcgaagctgggcgaatggcttatgaatccggcttgccatcacgagtaaaaatggcgacggcatcaagtccattaactggatttttggattttgtatcatgagcttcattacccacttccaacaattaggctgggatgacagtcggctatcgatttatggtaagacagcgcgggatgttgaacgcgctttatcttcacctaaacggacgttagacgatttcaaagcgctgatttcaccttcagcagagccttatctggaaacaatggcgcaaatggcttatcaggccactcgtcaacgttttggcaataccatgtcgatgtacattccgctctacctctctaatctctgttcgaattcctgtacctattgcggtttttcaatggataaccgaatcaagcgtaaaacactgaatgaagtggagattgaacgagagatcgcggcgattaaacgaatgggttttgatagcgttttgctggtgaccggagagcatgaaaccaaagtgggtatcgaatacttccgtcgggcactgcctatcatcaagcaagcttttcattatgttgcgatggaagttcagccgttgcagcaagaagagtatgccgagttaattgggctcgggttggatgcggtgatggtttaccaagaaacgtaccatccttcgacttatgcgcagcatcatttgcgaggcaagaaaaccgatttttggtatcgactcgaaacacccgataggttggctagagcgggcatcgataaaattggtattggcgcgctgattgggcttgaggactggcgaactgacagcatttttgttgcggcgcatctggattatcttgagcgacaatattggaagacgcgctactcaatttcttttccgcgtttacgcccgtgtgagggcgctttacagccgaaatcagtgatgacggatcgacaacttgtgcagttgatttgtgcatttcgtctgttcaatagcgaggttgagctttctttgtctacccgcgagtcaccgatgtttcgtgatcaagtggctaagctcgggattacctcaatgtctgcagcgtctaaaactcagccgggagggtattcagaccctaaggttgagttagagcagtttgcggtaagtgatgagcgttctgccgcagaggtgagtagcgcgttaatggagcaaggtttacaagtggtatggcatgactggcatcgagcctattcaggctaatgtttcactcaaattaatgtttcacgtgaaacccaaagcttgtattttacaaaaacggcatttgagattcggatagagccttttctgggttgaaacttggagtagaactgcgatttctcgaggctaaatcccatccacgatagcgacaaaacaaatagcagcaacaaaaagaaaaccgccatacgacggttttcttttctattctatgcggataaccagccagtttatacgtgactcaagggtgaggtggcttgttgcaaccactcacggacgtgagcctctttgataagcggactcacttcatcccacactttttgatgatactgattgagccaatggagttccggcttagtcagcaaattcacctcaatcgcacgtttatcgatagggcaacgagtcaatgattcaaaaccaagtacagagaaatcgccctgagttgcaaactcggtgaccagctctaagttctcgattcgaatgccgaacgcatcggcacggtaataacccggctcattggaaagcaccattccggggcgcaaagccacactattgtgaaccttcgcgatacgctgtggcccttcatgtacacttaagaaatggccgacaccatggccagtaccatgatcgtagtcgtaaccttgtgcccataagtgctgtctggccaaaacatcaagttgtgaacctgttgtgcctttcgggaagcgagcgcgagccaaggcaatgtgacctttgagtactaaggtgaattgttgcttcatctctgcgctgacctggccaatggccaccgtacgagtaatgtctgtggttccatcaaggtactggccaccagaatcgactaaatacaggctatccatagaaagctgacccggctcaggctgattttggtggttgtagtggcacatagcggcgtttgtaccagctgctgaaatcgtatcaaaactcaagtcaaccaaggttgggtcttggcgacggaaggcttcaagtcgatccgccagctcggcctcattatgcaggcgaccattagccacttcattgtccagccaagcgagaaattgcaccatagctgcaccatcgcgaatatgacaggcacgcatgcctgcaatttccgtgttattttttgccgctttcggcaggaggcatggatccgcttcgttgagcagttcagcgcccgcattttgtaaggtgagtgtgaaccatgcattgctggtcgcagaatcgagcatgacgcggcgaccagagagttgatgcagttgagcttcaagctgatccggatgatgcacgcgaaccgtacctgctacatgggcatcaaaatcggttgccaagcgcgccggatcgaaaaagaaatccacactgctgtcgttatggacaatggcgtgagaaagcaacacgggtaagcgagatacatctaaaccgcggatattgagtagccatgcgatagaatctagttcggtcaacacgacgcaatcggcgtttttgtcgcgcagagtgctggcgatcgattgacgcttttcaaggctgctttgtccaacacgatcaagaggtattaagcgcatttcagaggctgcgggaactggacgatcctgccagagtaaatcaatcgggttactgctgactgcacacaagttaatttttcctgcgagctgtttttgtgcctgtgttagccagctaccacggtgcatgcgaggatcgtaacccactttcgctcctgcgggcagttgagtgacgagccagtttaaataaggttgttcgatcaagtggcaatattcgaatagctcactagacacttgtttgcggacttgaacggtatagcggccatcaacaaaaatcgctgcgccggagagggtaacgatggcggctcccgcggaacctgtaaacccagttaaccagtgtaagcgctcattatgctcaggaacgtattccccaagatattcatcttcatgaggaacaatgaaggcatcaagttgctgggtgtgtagccagtggcgaaaatccgcgaggcgttgagagtgtaggtttgacatctgaagtgatcctttttctaaacagtccttgttatctcttgtgtatggattatacgaaccacatacagcaagtggacgagagcgaataagctactctttttgtgtacgctgcgcaaatatccgactatcaactcagcgtaaatgaagcgtattggtttgtatcagttctcgtaaccagcgcagcgcagggtcattctctcgttcacgatgccaaaatagtgtgtatgccataggtggaaactccatcggtaatggtaattcaaccagatccatctgcttggcgacccagtgagtaaagtggctcggtgcggtaaaaataaagtccgtataggtgcacaaactggctgcactattgaagtctggtacggtaatcgcaatgtcgcgctcatagccgagatcggctaatcgataatccagcagccagcgatcatttccatcacagcgcacttgtacatgacggaggttgagatagctggataaattccaatcatactgaagtaccgggtggccgcggcgcaccacacagcgctgattatcgcggtagatctcttgttcacaaatgtcagcaggaggcaataaggtcaacttcgcatcattgatatcaatgtctttaccagtcagaccgaaatccagttcgccaacttgtaatttacggaaggtttgttcagtccatgcatgggtgctgatgctcagatgaggaccgtggcgaaaaatcgtcggtaaaaagtagggcatgatcaatggataaacactttcgaccgccgcgatctgaaagcgatattcgctggattggggggagaaatgtgcgggctgagttagtagctcaagctgattcaccaacacatccagtttgggttttaagaagagcgccttcggggtcgcattcagtccataagacgtgcgaacaaacaacgggtcgtcaaactgctcgcgtagcttggctaaggatttactcacggccgattggctcagacataaacgtgcagccgcgcgcgtgacgcttaactcttcaatcaatacttttaaacagaccagtagattgagatcgatacgggccaatttttcaatttgcatgagtttttccaaaatagaataacagcaatgacgatataccactgtttagcatatcttgagccacgtatcatgcaccgatctttaaaattcagtcggagtgtgaagtgaaacaagcaatgccatctcaggtcagtaagcagcaaatggtgctactgacactactcgttctatttagcccattggcgatcgatatttatctaccggcattgcctcaaatatcacaagcgtttcacgtggaacacgctttagcacaagatacgattacctggtttttgtttgcgatgggcgtcgggcagttatttgctggcccattagcagataagtatggtcgacgaactgttgcattagggggcattagcatttatgccttgagcgctttattggcgtggagtgctcaaagtattgaatggatgttaatggctcggttgctacaaggcttaggagcgtgtgcgacttccgtagcagcttttgcaacagttcgcgatttatttgggccgcaacgcagcggtaagatgatcagttacctcaatggagcgatctgttttattccggcactcgcgccgattctgggcagttggttaactcagcaattcggttggcgagcaaacttcagttttatgaccggatttgcgctgctggtagggttagccatggctctacgtctgcaggagagtaatccgtacatgggcagtcgacctgccgtctttaagctctctcgttatgccgccgtattaaaagcgccgaccttcctcttccacgcatcgctgtgtctgctggcgatggcggtgattctcgcttacgtgacctccgcgccagtgattctcatggagcgtttacagctcagcatgaatgaattcaccttctggtttggcgttaatgcggtgatcaatatcattgcctgcatgacggcccccaaagtgatggataaattgggtactcgttggtctttgatcattggcattactacgttaatgatcgctggcagtctaatgctggtgctgcgtaatcaggcaagcgcactggcgttcatgttgccagtgtttttatcatcgattggttttgcatggatactgggcgcagccgccggtaaagcgttagctccgtttggcgataaagccggtacggcggcggcattgctcggactattccagatgagtggttctgggctattggtcggtacgttgcaacgcattatgcctgagccgcaactactgatcggtttgaccatgtggctagcggcacctgcgttactcattttattctcaccgcttggttttcgttggcacgccagtgtctctgagtgttgatagaacaagataaattcacgctgaggctattttactcagcgtgcatcctgtgtatattgtttgcctcttcgatactgactaaccgtttggaatccaaaacaccatgtctctaaccacctatgaaatggctcgcattctggaacaacttgatgaatctccagaaaaggtgatgtatggcaagttgcttaatgaattaggcaatcaaagcagtgaacgtattcgcagtgcggccaagcaagtgccactgaccgtgctacgcgatctggtttaccagttccagcaagtgatcgagtcacgcaagggcgagcaagtcgaaaccatggctaaagaactcgctaaacagggcatctctgcggaagagcttctgaattacttacaaaaacgctaatcgaacgctcattccctatatcgccttgttcgtgtaccacgataagtcaatgacaaggcttagtgatactcagcgatccgttataccgttaaggattaacgttacggctgatcgggttttgcagggaaatcagcgtttcggtggattgtacttcatcgatggcttgcagtttgtcgatcaatacatgctgcagttcttcaatcgagcggcacatcagcttgacgaaaatgttataagctccggtggtgtaataagcttcaaccacttcatccagtgcattcagtttggcgagcgctgaatggtaatcacgcgcggcattcaaattaatcccaataaaacaacagacgtcataaccgagctttttggtatttacgaccacttcggtgccttggataatatcggccgctttcatcttctctattcgcacgtgaatcgtagctggactaacattaaactgtttggccatttctgcgtaaggcgtgcgagcatcgtccattagaattttcaggatggcgcgatccaattcatcgagtttggtggtggtttgcattgtctttcctgacagtcatgccgacatgaaattaaagtgtgcttactttaccaccattaaaacgattgtttaaccttggagtctgacttgagccgattgcgacactggtacaacaaatatgcgctgcctcttgctgttgggttgggctgcttttggacggccaacctagtcgcgcaagaaccaaccttatcgagccaaccgttagacaatctaggaacgagtcgcgtgccatgggacagcgagcttgcagcaaacgccatgttgtggattgtggcgcttgtcgccatcatggttttaagcatcttaacagtgcgccagtaccactatattcaacgcttacgcaccaaccaaaaattactggagtcgatctttgatcaaagcacacactacatcggtatctttgacttagaaggtcggattatttcctgcaatggcaagttacagggactgctgtatcgacatggtgaaagtttgctaagaccgatctggcagcacaaaggttgggaggattcagcggtcgaacacattcagaactatttctctgagtcagtgccgcaaactcgccagtttaacgccgaaatttggcatcctgagcttggagccatcgtgctggagtgtcagtttaagccgctaccgactcgcgaagagtcgcaaattctgcttgaagcacaagacattacttggcgaaaaattaccgaagataaactctttcagcgtgaagccagccttcgccattattacgatcagcagccagtgatgatgctaaccttggatgagcgtaaccacattcaacaagtgaatcattttgctgaacagctgctgggttatcccgccgatgtcatgcttgggcaccatatccgcgatttttatcaagatgaagaggtactgacaccaaggcagatgctactgctaccgagccgccatgcttcttctgtttggcggcgagaagtgtgttatcgccatcactccggtgaaacggtgtgggtacgggagaacattcgtccgctggtcgaaacgggcacgctgttaatcgttggggaagacattaccgaaacccgccagcttgccgaccaactggcgtatcaagctcgctatgatttattgacccacactctaaaccgaaaccagtttgagctagaactggccaaagcgctgaaagaaaccgacagtcaattacgcacccacgccatgctgtatctcgatctcgatcagcttaaagtgctcaacgataccgcgggccatgatgcaggcgatggcgcgattcagttctgtgcgagcatgctggaagatgtgttgccctttaaagccaccttggcgcgtatgggcggcgatgagttttccgtattactgcgtgattgcaccgagcgtgatgcagtgttggtggcgcaaagtattatccatgcgctcagtgaagtggcgtttgtctgggagcatattcgctttaatctgacctgttcgatcgggatccgtatgattgaccatactgcgacatcaccacaaatggtgcatgcacaagcggatacggcgtgccatgccgccaaagaggaaggacgcaatcgcttcaacctctatcgacaggatgatgaggatttgcgccggcgccaattggaaatggagtcggtgaatctagtgcacgatgcgctcgccaatgagcgaattgagctatttgctcagcgcattgtgccgctcaatcaacccgatgtgttgcttcatttcgaagtcttagtgcgaattaaaaacgccgcaggggagtacgtttcaccgggcattttcgttcccgcctctgagcgttataatttggcgcaccgtctggatcggaaaattgtcgagcagacctttaactggttggaagcgcgtccgcaagtgttagataaactggggcgcgtttcgattaacctatcgggtaactcgattggcaatccagattttgtggcctttctgctcgaaagattgcgcgatagccgcattccatgcagtaaagtctgttttgaaatcaccgaaacggctgcgatgcgcaatctcaatcaagcgatcaaagtgttatctcagctcaaaagcttaggttgcgtgttggctctggatgattttggctcggggctctcctcgttcggttatctgcagaaactgccggtcgatatcgtcaaaattgatggcatttttgtgtgtgatatggacaaaaatgagatggatcgcttgatggtccgctctatccatgaattgaccaagcagatgggcaaaagcaccgtggcggagtttgttgaaaaccagcagatacttgaggctttgcagcagattggtgtggattacgcgcaaggctatctattcagccgcccacaaccgatcgctgattgggttgccgagcaactcaaagagaaagcgtagggtttgccgataaaatccgctacactgagcgccgttttatctcggttttcggagttcccttgttgattcaactgatttgccaagcgcctcaacgtgcgcaagagttggagcagattgctgcgcgttggcaactgcaagccagtgatgatagcccatttgctttggtactcagcgaagagcgccttgagctacgcaaattagatgaacctaaactgggggccatttacgtcgattgggtagaaggtgcagtcgcacaccgccgcaaatttggtggtggtaaagggcaatcgatcgccaaagcggctgggctaaataaaggcgtcacgccagtggttttagatgcaacggcgggtttaggccgtgatgcgtttgtgttggcgtccttgggctgtcgggtacagatggtagaacgacatcctgtggttgccgccttactggaagatggtttacagcgcgccaaacaagatgatgaaatcggtgcctgggtcagtgagcgcatcagtctgctgcacgcctcaagccatgatgcactgcagcaattggcctccgatccgaattttacttcgcccgatgtggtctacctcgaccccatgtatccacaccccgaaaataagaaaaaaaccgccttggtcaaaaaagagatgcgcgtatttcagtctctggtgggggcggataatgatgccgatgctctgcttgaacctgcgttgcaactggcgcaaaaacgggttgtggttaagcggcctgattacgcgccgtggctgggtaatcgaaaaccgagcatggcgatggaaaccaagaaaaaccggtttgatgtttatgtgattgccgcgatgagtggcgaatagcgcgctggccaatcaagccgctttgctcacgaagcgagggcacaccacaatctgacttgtgtttttggatgaaggacgtaatatctgcgtctgagaataattcgtattttagctggagtggttgtggctaaacgtctatgcaaactcagtcgtcatgagattgcgacttccctaagtgaaattgagcgtctggtcgctgagccgcagtttttgtgtcgggcttgtgcgcgcgtggcgggggataaaaaaagcttgtgtaaaccgcaagccatgagtcttccggcgcccgtagcgactgtggtggcacttcctgctcatgaaagtggggtggtcagcctgcttcccaaagccagccttaaaaagcagcgcaaattccacaaaaagctggaaaaagtgcttaaaaagcagcgtaagttaatgaaaaagcagcaactgctagaaggcaaagttggacaaaggcatccaacaccagtggtagagagagcgacagcgcagagcatgcattgagctgaatcattgcgctgaagtgtcaactatcgcagacctaaaaaagcccatctccgatgggcttttgcgtctcttgatgagtcatttcatctcggttagagcaaaccttgacgctgataatccctttctactcggcgtttcacccaagtttcattaatccacagcgagccaagaataatcgcaccacctagcgataagcgcaccaaatcgacttcgcggttccaaatcagaatatttaccaccaagcctgcgggtaccaaagcgttattcatgatggctaacgctcccgcgttgaccatgcaggcgcctttgttccaagcaaagtaaccaagcccagaagcaatcagtcccaaatagaccaagatgctccattgcactgaggtcgtcgggagcttttccggattacccagcagcagaaaagcaacgctggccaccagcaaagcgcctagatagaaatagccaaataccgtgtgttggggcaattcggtagactcttgttccatcacatatttgtagccgacttggccaatcgcaaagcagaggttggctccctgcacgacaagaaaaccggtcacgaagtgttcattaatgccagcgaatttaatgaacacggcaccgagcacagcgataaaagcggtcactaaataccaaggcgagaaacgccctttaagaaaatcgtaaatcagcgtgacataaatcggggtaaaaacggtaaacagtaagacttcgggaaccgagagcagcaagaaagactgatagtagaaacagtacatcaagccaagctgaacgccgccaatcgccattaatttggcaatcagggcgcgcggtacacctttgaaacgcagaaagggaatgaagactaaactcgcgagagccactcgcatccaaacggcaaaccaagaatcaacctgaccagcgagataaacgccgatcaggctaaatgaaaatgcccataacagggtgactgctgaaagataaaccataacgctattgaatgagtgaatggaaatcagcagtctacctgagtattttctgttcgtcagtcgttgagtggaatgactaacatatccactggcgagctgttgatcagttgccgtgtggaagagagcagtttgctccagaaatcttggtgatggccacacaccagtaaatccacgttaaactcgctgatggtttcgcacagctcattggttaaatcgccgctaccgaccaaggtatgcttgatggggtaattggcatgctgcgccaaatcctgcagttgcttttgtgaagcttccatcgcgtgatgttgcgtttcggccaaattaatgtcgataaggcccgtgtacagctcggcgtagttcacgtcgatatgaataaatgagacttccgcattgagaggtttggccagagccaccgctttttcaaccagcagtttgctgtcttcagacaggtcgaccgcaaccaaaagatgttgataactcattgtactgactcctattcgggtgactaaacacagcgtagcactggagtggcgatttttttgtcgcagcgatctcagtttgatggcgatgggttaggtgatgactacaataactaccgaacatgctatagtgcgttcaaatagttagagtgaatcaggagttttttatgttgtcgcaagcgatggtagaacatctcaatgagcaaattaacctcgaatttttttcatccaatctatacttacaaatgagtgcttggtgtgaagacaaaggatttgacggagctgcagagtttttacgcgctcacgcggtagaagaaatgcagcacatgcagcgtctgttcacttatgtgagtgaaaccggtgcattgccaatccttggtgcgatcgctgcgccacgccacgattttgcttcactgggtgaagtgtttcgtgagacgtaccaacatgaacagaagatcacgcaacagattaataaactggctcatgtggcgttcacctcccaagactactcaacatttaacttccttcagtggtacgtggctgaacagcacgaagaagagaagttgtttaaagggattttagataagctagagctggtcggtgaagatggtaaggcgttgttctttatcgataaagatctagctgcattggcaaaaaaaggctcatcttctgtcatggatgcccctgctgagtaagatcagcaaaaagacaaactgaagcgatcgtctttttctctgggcattctcaacacaagatgtagggaggaaaagatgatcagtggagataccattctatttgcgcttatgctcgtgactgcgattaatgtagcacgttatgtgacagcgctgcgctcgcttatttacatcatgcgtgaagctcacccgctcctttatcaacaagtcgatgggcgcggctttttcaccacccatggcaatgtgactaagcaggtgcgtttataccattacctgaaaagtcgtgagtatcaccaccatcatgatcctgtgtttactggtaagtgcgatcgggtacgtgagctgttcattttatcgggttcactgttggtgctcaccactgtcgtcgcgtttatgctttagtgcgccggagagcttttcgaatgcggtttgccaacacgtgcattgcgttggcagagtagcgatttgccgttagaatagccgcccaagtgagtaaggatgtgcactcagcacatcctttttttatgcgattaggtggcagtgatgagcaaaacagtcgatgtggtaattattggcgcaggtgcggcgggattgatgtgcgcagcacaggcggcgcgacgcggccgtcaggtattgctgctcgatcatgctaaaaaaccggggcgaaaaattctgatttccggtggtggacgctgtaatttcaccaattacgatgtctcggcggcgaactacttgtgccaaaacccacactttgtgaaatcggcgctgtcgcaatacaccaactgggattttatctcgctggtcagcaaatacggtattgcctttgaagagcgcgatcacggtcagctgttttgtcttgattcggccaaagagattgtagacatgctactcagcgagtgtgaccaaccgaatatcgagcagcgctatcaagttgaaatcagcgccatagcccacaccgagcaaggttttactctgcaaaccaccataggtgagattgagtgcgcgtcgctggtggttgccaccggcggtttatcgatgccgaaactgggtgccacgccgtttggctacaaaattgcagagcagtttggcttgcccgtgatcagtaccagcgcaggtttagtgccatttacgttgcatgtgcaagataaggaagatttcgcgccgttatcgggtgtggcgattcctgttgagatgcgcgcagaatgcggtaaaaccttcaaagaagccttgctctttactcaccgcggcttatctggccccgcggtgctgcaaatttcctcttattggacgccaggacaaaccattaccaccaatttagtccccgacgtggatttggctgagttgttgagtagtgaaaaagaagcgcacccgaaccagagtttgaaaaataccttatcgaaagtgttgcccaagcggctggttgaagtgctgattgaacgccaactgtttgccgataaaccgctgaaacagtattcccccaaagagctcgacgcggtgcaaacccgtttagagcagtggtcgattgtgccaaacggtaccgaaggctatcgcaccgcagaggtgacgcttggtggcgtggataccgattgcctctcatccaaaaccatggagtgcaaaaccgtcaaaggcttattctttatcggtgaagtgatggatgtgactggctggctcggcggctataacttccaatgggcttggtcgagtggctacgtcgccggccagtgggtttaggggttaagttttgcttcgctaggttgcgctttacggccttgccactgctgaaccacaagtcccgcaataatcagcactaaaccgatcaaagtggttgggtggatcgcttcgccaatgatggtcgcgagtagaaacagcgaaataaaaggcgaagcaaaaatcaggttactgatgcgtgcggtgttctgggtatttttcagtgcgctgagccagagtacaaacgtaatgcccatttcaaacagtcccacgtaagtgaccgctaaccaaccttgggtggtgatgccttgccaattgaggttttcgtgccaacacagcgccagtgcaaacgggattgccagcagaaagccgagtaacaccccaacgatcggatcagctttatttttggtgttgagaatccaatatcccgcccacagcagagtcgacagcagggcgagaccaaccccgagtggactttcaaattgcaggccgagcagatcgccttttgtggcgatcaccaccacaccgagataactcattgcacaggcgatccaatcttgtttacgaatgcgttggccgagaaacagtgccgccatcaaggtgagagtaatcgcccaactgtagttgatggcttgcgcttgtgaagcgggtagcagcgaataggctttaaacaaaatcaggtaataggcgagtgggttaatcaatccaagcaacaggtagtaaaacggatttgccagtaaagtggggacgatcagcttaagcttgtccatcgcagcacaaatcaccagtaacgcgagtgcggagacaatgctcgccacggtcaccatttgcagcgggtttaactcggccagcgtcaatttaaaggcagtcgcgaccgttgaccacaacagcaccgaagccaagcccaaactcaacgcgcgtttttcattcatcctgaaactctcttatccttgtttttcgctagtctaggggagaataaacgcgcaacaaactggacatttatccagtgccgaaataccattttgatcgagataaatcacagtaagtgttcaacatgcaatggatttttgaaaatcaaagcgcattgtggtcggcgttagtgagtgcaggcgccactggggtggcgatcggctggtgggtcaagcagcgctaccaactgaaaacccaattgcttgagcaacaacttgagcagcagagccactggcatgcgcagcaaattcagcagcttaatgagcagctcactaccgcgcagcaagagttggatgagctggatgcgttacgtgacaaaaacgaatttgaactcaagcaatcacacggcaagttaatggcagtgctggaaaagctgcgttactttgaggcggtgaaacaagagcgccagcagtatgccgatgagctaaaccaagtgcgcgccgcgaaagccgagttagaaagccaattgcgtgaacaagaagcgcgtcatcagcagcagttggtggcgagccaagaaaaattgcagctgcttgaacgagccgaagagcgcctaaagcagcaatttgagcatttagccaatcaggtgtttgagcacaaaaccgccacggtcgatgtgcaaaaccgccagagtttggaaggtttgctcacaccacttaaagagcagctcgaaggttttaaaaaacaggtcaatgatagctttaaccacgaagccaaagagcgtcacaccttagtgcatgaactgcgtaacttgcagcgccttaatgagcagatggccaaagaagcggtcaacctgactcaagcgctgaaaggggataacaagcagcaaggcaactggggcgaagtggtgttggcgcgtgtgctagcggaatctgggctgcgcgaagggcatgaataccaaactcaagtcagcttacaaaacgaagcgggtaagcgttatcagccagatgtgattgtccatttgccgcaaaacaaacaggtagtgatcgactcgaaaatggctttggtcgcgtatgagcgttacttccatgcggaaaccgatagtgagcgagatagcgcattacgtgagcacttacttgcgcttcgtaaccatattcgtgggctagggcagaaagattaccatcaactcaaaggcattcagagcctcgattacgtgctgatgtttattccggttgaacccgcgtttcaagtcgcgattcaagccgacccaagcttggtcaacgacgcgatggagcagaacattattttggtgagccccaccactttgctggtggcgctgcgcaccattgataacttatggcgcaacgagcggcagaatcaaaatgcgcagctgatcgccgaacgtgctagcaagttgtacgataagctgcgtttgttcgtagaagacatggaagggctaggcggcgcgctggataaagccaatcagagctaccaaggggcgatgaataagctggtgactgggcgtggtaacgcgattcgtcaggcggaaagcttcaaacagcttggggtggaaatcaaacgttctatccctcagccattgattgaacgcgcacaacaagcgccggatcaggaaaatgcccctttagtagaaagacatccgattgaggataaagtaaactaatcgcccgcagtcgccgcagtcatgacggccaaagaggaaaaataatgacggacaccaacgtgctagcaaactctgcaacagacaatcaggaaacgacccactttgggtttgaaaccgtacgtaaagatgaaaaagtgcataaagtcgcgcaagtgtttcactcggttgcggccaaatacgacatcatgaatgacctgatgtcgggcggtatccaccgtttatggaagcgctttaccatcgattgttcaggcgcacgtccgggacaacgcattctcgatttgggcggcggtacaggcgatttaaccgcgaaattctcgcgtattgtgggcgagaaaggccatgtgattttggccgatatcaataactctatgctcaatgttggccgcgataaactgcgcgacagcggcgtggtcggtaatgtgcattacgtgcaagccaacgccgaagaactgcctttcccagacaactattttgactgcatcaccatcagtttctgtctgcgtaacgtgaccgacaaagataaagcgctgcgttcgatgttccgtgtattgaaacccggcggccgcctgttggtgctggagttttctaagccgatccttgagccgctgtctaagctttatgacacttactcgttccatattttgcctaagatggggcaactgattgccaatgatgcagacagctatcgctatcttgctgagtcgatccgcatgcatccggatcaagagactctaaaaggcatgatggaagaggcgggttttgaacaaaccacttattacaacctgaccggcggcattgtggcgctgcatcgtggttacaaattttaagggctgctatgtcattgcttgcaaccatgccactgtctcctttgctgaccgcggtgattgaaaccacgctcaatacgctcatcaacgatgatccggcgttaggccgcaaactgctgcgcctgaaaggcaaagtgatttcgctgcatctgcgagagttaaatcaatccctgacctttgtgttcagtcagcgcatcgatgtgatgaccggctttgaaggccagccggattgctatctggcattaaacctctcgattcttcctcagttgcgtgagcaagccaatattacccagttgatcaagcaagataagctagagctggaaggcgatatccaactggcgcagaagttttccgagctgatgaccgattgcaaaccggatgtggaagagtggttatcgcgcatcacgggtgatgtggtggcacacagtgtcgtgcatggtgtgaaaagcatcgtcggcgcgctaaaacagcaagcgcataagcatcaaaaccacttggcacaggtgctcactgaagagtggcggattgcgccgccaccgttggaaattgcctatttttgcgatcaagtggatgacgtgaaaagtcacgctgcgcgtttagaagcgcgtttgaaccagttactggaaaaagcatgaaacctgcagagctgaaacgtttataccggatagttaaagttcaactcgaatatggcttagatgagctgttgccagagcatcatctgacccgagcgccgctactggcgcgtaaatctcttttttggctgcgcaatcaacacgccgataaagcgttaggcgatcgtttacgtttggcactgcaagaacttggcccggtgtggatcaagtttgggcagatgatgtcgactcgccgtgacctatttccgccgcacatcgccgatcccttggctatgttgcaagataaagttgcgccgtttgatggcctacaagccaagcaattgattgaagaagaactcggtgcaccgctggaaacttggttcgatgactttgatatcaaaccattagcttccgcgtcgatagcccaagtacacaccgccaagctcaagagtaatggtcgtgatgtggtgctgaaagtgattcgtccggatattcgtccgcagattgatgccgacatcaagctgatgtatcgcgtggcacgcattgtggctaaagcgctgccggaagcacgccgcttaaaaccggtggaagtggtacgcgaatacgagaaaaccttgctcgatgagttggacctgcgccgtgaagcggccaatgcgattcagctgcgccgcaacttcgaaaacagcgaagagttgtatgtccctgaggtgttaactgatttctgtaatgaaactgtcatggtttctgagcgaatatacggcatccaagtttctgacttggcaggacttcatgccaacggtaccaatatgaagttactggcggaacgtggcgtgagtgtgtttttcacccaagtgtttcgcgacagtttcttccatgcggatatgcatccgggtaacgtgttcgtcaatcctaaccatcctgaaaacccgcaatggattggtttggactgcggcatagtcgggacactgaatagcgaagataagcgctatctggccgaaaacttcctcgccttcttcaatcgtgactatcgccgcgtagcgcaactgcacgtcgattccggttgggtaccactggataccaatgttgatgagtttgaagtggcgatccgcatggtgtgtgagccgattttcgccaaaccgctgtgtgagatttcatttggtcacgtgttactgaatctgtttaacaccgcgcgacgcttcaatatggaagtgcagccgcagttagttttgctgcaaaaaacactgctgtatgtcgaaggcttggggcgtcagctctacccacaactcgatttatggcaaaccgccaaaccgtttttagaaaagtggatggctaaccaagtggggccacaagctttcttgcatgcattgaaagagcgtgcgcccttatggtttgaaaaaatgcctgagctgccagaattgttgtatgacagcttaaagcaaggtcgtaacttgaatcagcgtttagataatctttatcaaggttatcgccaatccaaacgccaacaagggacgggaaagtttttgtttggtgttggagccacattagtcgtatgctcggcgatatggatctccaaccaattagaacctttagcgatcggtagcgcgaccattggcgtgttatgttggctattgagttggcgagcttatcgccagtaagcgccttgtcgcgtcgataagttcgaagatttgttcacacataacccgaggtaaaagagatgggtggtatcagtatttggcaacttcttatcattgcagtgatcgtggtattgctgtttggcactaagaaactgcgtggtattggcagtgatttgggcagcgcggtcaaaggctttaagaaagccatgtcggaagaagagtcaaacagcgcagcaaatcagaaagatgctgacttcgaaaccaaaaatcttgagcaggccaaaaccaatgcgtctgctgaagtgaaaaaagacaaagagcaggcataagtcgtgtttgatatcggtttttgggaactggtattgatcgctattgtggcgctggtggtgcttggccctgagcgattaccccatgcgattcgcagcgtggcaaagtttgtctctgcagcgaaaagcatggccaatagcgtgaaggatgagttagcgcatgagttgaaagtgcaggagttgcaagaaaacctgcgcaaagccgagcagatggggatgcaaaatttatctcctgaactgcaaaaatcggtggaatcactcaagcaagccgcgcaggaagtgcagcgtccttacgccgcaacgccgagcagtgaagctagctctaccagtagcaaccccagttcggctacagagcccgatgttcgcctcgatagcgcgtcgcaaccggcggaaaaaaaggccgaataagcgttttttaagctctctttatcaagagttatcctaggtttcagtactgatgtgataactcttttttgatctgttacatgaggtttgcatgtcttccgttgaacagacccaacctttgatcagccatttgttggaactgcgtaatcgcctactcaaagcggtggcggctgtggtggtgatatttattggcttgatctatttctcgaatgaaatttacgagtttgtctcaaaacccctagtcgagcgacttcccgcgggcgcaaccatgattgcgaccgatgtggcttcaccctttttcacgcctttaaaactgacgttgattgccgcggtgtttctcgcggtgcctttcattttgtatcaggtgtgggcttttgtggctcccggtttatataagcacgaacggcgtttaatcttcccactgctggtctctagctcgctgctgttttactgcggtgtcgcgtttgcctattttgtggtgtttccgctggtgtttggatttttcaccgccatttcactcggtggtgtggagttcgcgaccgatatcgcgagttatctcgattttgtattggcgctgtttctagcctttggtatcgcgtttgaagtgccagttgcgatcattctgctgtgctggacgggcgcaaccacgcctaaaagcctatcggaaaagcgtccatacattatcgttggtgcgtttgtagttggtatgttactgacgccgccggatatgatttcgcaaacgctactcgccatacctatgtgcttgttgtttgaagttggtttgttcttcgctcgtttttatacccgtgatgaagccgatgaaggacaagaggaagaagaataaagagccgtgctttgagcgctgcgtaaagtcaagaagggcaccttatcggtgccctttgtttttggatcagcacaaagtttgaccgacttcgctttttgatgatgttgtcatcgccatctttgatttaaagcaaatctatcttggttagtgttcgcaccgcggcgaatttctactattcatataagcaggctctaatttaaagcgattcgtaaacgcttagagcatagattcagttgcacatcaggagccgtaacacatgtcagcaacgtaaagccacaataaaaccaataacataaaacaaggaagccattatgaaagtcgttcttacctcgctgagcttagcgatatccctctccctcgctgggtatgcttttgcggcatcgccaagaaacgaacctgtttcccccattttacctgcgcaggaaatccacattggaaaagccgagttgggtaaaaaactgtactttgatccgcgcttatccaagtcagggtttatctcgtgtaactcatgccataacttgagcatgggcggcagtgataacttaaaaacgtccatcggtcataactggcaacaaggtccaatcaactcaccgactgtgctcaattccagtttgaatatcgcccaattttgggatggtcgagcggccgatctgaaagagcaggcgggtgggccgattgccaatccgggtgaaatggcttttacgcatacgttagccattgatgtgttgcaatcaatcccagcttacgtgagtgagtttcgtctagtgtttggtaagccaaccctcgatatcgatcaagtgactgaagcgattgcggagtttgaaaagaccttagtgaccccatactcacgttttgaccaatggttaatgggggatgatagcgcgataacggctcaagagctggcaggctatgaattgtttaaaaactcgggctgcgtggcttgtcataacggcagtgcgttaggtggcaattcgttccaaaaaatgggtttgattgaaccgtatcaaaccaacaataaagtcgaaggactcagtgcggtaaccggcgctgacgccgatcgctttaaatttaaagtcccgacactgcgcaatgtggcgttaacgtatccctacttccatgacggagaagcggccacgcttaaagacgctgtggatatcatggggcgtttacagctagggcgtaaatttaccgatgatgaaaacggtaagatagtggctttcttgcataccttaacaggagagcaaccaagctttgctttacccattttaccgccatccaacgataatacacctaagcctcagccttttgattagttgaggtaagcgcctgctggctcggtgttttacctgccagcgggctttgctatgtttcgggatggcgatatctaaacagctgctacttaaacgatcggaggtggtttaaatggaaaagcgagccggtaaaaaagtccccgcgcgccattgagtataaaaggtagcccctaaggtaaaaccacgcagtgccataaagctgagcatggctagccacagagcgtgattaccgtagtgtgtcatgaacccgtaaatggcaaagaacgctacggccgaaacagccatgctatttcgcatctctttgcctttggtcgcgccgataaacacaccatccaatagaaaacaccacacggcgattaatggcatggcgaccagccaaggcagataatgttccgccgttgcttgaacgctcggaatgttagtgatcatttggatcagatccgatccaaaacctaagaagatcaggcttaacagcaaacagatcatggtagcccaaaaggtactgctaatcatggcagtacgcagttggcgatcatccttggcaccaattgctttaccaaccatggcttccatcgcgtaggcaaatccatccataccgtaggaaatcatcatcaaaaagctcatcaacaccgcattagcagcgacgatgtcatctcccaacgctgcgccttgaaaggtcataaagctaaatacggcttgcagacagagtgagcgtaggaagatgtcacgattgagcgccactaaacgggaaagctctttggtgagagaggggatgaaagagaaaggggctgggagctgatgctgccgccagtaacgccccacgcacaggagaccaaacaagagaccagcataatcggcgataaccgacgcaatggcggctccttcgactttcagcccaagcccgagtaccaacagcagatcgagcacaatattggtgaggttggtgatgatcaccatccacatcggagcgcgggcattttgggtgccgagtaaccagccaagcagtacaaagttaagcaaggcggctggggcactccaagcacgaatgtagaaataggcttcagcgtaggttttgacttcgctgctggcatcgctgaagtgaaaaatcagttcggcgacagggcggtgaaacagtaaaaacagtgcggctaaacccagtgcaatgacgctgccttgcagtaaaactcgagcaagctgctgtgaattttgcgcaccgtgcgcttgggcggttaagcctgtggtcgacatgcgtaaaaaaccgagcagccagaatgtcacgctaatcatagtgctgccgagtgccacgccgcctaaataccaagcgtgttcgagatgaccgatcaccgcagcatcgaccaagccgagcagtggaacggtaatgttagacaggaccataggcagcgcgatcgccagcacttggcgatgcacattcggttgtttcaacgtttgcaaaatcagtgacacacagaacacctcagtaacgacttgcggttagtgtaactgagtggggatagttgggctatgacatgaccgagatggcgggttaccaatctaggttaacaacaacaggggttaagcgtgttttgtaaatgccggagcgtgcaatcgcgcgttgccaaaatttccagcgatcacaatggcgatccagtggtgagaaagtgcgtaccgatttcgcccacggcaagcaattgatgatggcatcacctgcgcaggtaaacccgtgggcataagcttcacagcccagtttttggcctagatagctggaggttttatctcccgccaccacaaggcaggcgctggctttggcaaaatgcaatccgatagagcgcacgaaacgcgccacttgctgagcatcgcaatcgagcaaggcatgttcacagaccaacagcacaggagcgaattcggggatcggcagttcggcaagtccttgtggttgcatcacatcaccacacaccagttgataacgctcactgctgtgaaatagcttctcacgccataaaaggttttcagtaatatcccactcaatccagtggcagcggccgttatctactcgataaaagcgggtgtcgaggcctgcaccgacattaatgatccagccatcaggatgagtatcaagaaagtggcgaacttgttggtcacaaagttgagtcaaagtgacgtggagtaactgcttttgagcgatatcgcccgtcaggcagtcttgcgctaaagcgcaacgcctacaggcattggctgcaatcggatcatagaccaagccattatcgaccaagctttctcggctgcgcagccaaagtggctgaaccaaattcgcaggaacttggtatgagtctgaggtgggtgaatctgagtggcgcatgctcatcttcctatactgggataggaagatgataatgaatctcaaataagaaggcaagttgttgagaatttatctcaacaatcttcacatccaagtgctgttgcgaatgacgcctactgcaatgccttcaatggtgagcgattgcgcggctaaatcgacttcgattggcgcaaactcttcattttccgcatgcaggaaaactttggaacctttgcgctccagacgtttcaccgtgacgtcatcttctacgcgcgccaccacgacttggccgttgcgtacatcttgtgttttgtgcacagcaagtaagtcaccatcgaggatgccgatgttcttcatactttcgccatgtacacgcagcagaaaatcggcttgcgggcggaacatgctcggatcgacttggtagtgtgcttccacatgctcttgagcaagaatcggttcacccgcggcaacgcggccaatcaaaggcaagccagtttcggcttcttcttcgtttgcggcgttatcgacgaggatgcggatcccgcgtgaggcgccgggcaccatttcaatcacttgtttacgagccagcgctttgaggtgttcttcagccgcattggccgaacgaaaacccagctctttagcaatttcggcgcgggttgggggcattccggtttcatcgatcttacttttgatcagatcaaacacttcttgttggcgaggggttaacggcttcatgagtcacctgtctttttatacagttgactgtgagtatatccagtgcaatgagaattgcaaagccaattgcttgttttttgtgtgattgtgaagttcgccactggattgcgttctccataatggcttcaaagacggtgtggctgcctcccatttcactcggaaatgctgcgcatgtaagcaattaaattaaaaggtttgaccagtttctggtattcttggcgcgcaaaaaacgataccgcacgatggtgagctctcgcgttggccgtgaaagcagacgtactgtcgcgcttatttcaagaatcttgaggctttgaactctatgtcttcaggacacctattatcccgttcactactgaagttgccgatgtcggtgctggtgaaagggacggcgattccgtctaatccgatccaagatctggatatcgatactcataaaccggtgatttacgccttaccgtttcgctccaacgtcgacttgctgacgttgcaaacacatgccaaagaagctgggctgcctgaccctttagagcctttgatgctgaatggcaaagctttccagcgctatgtgtttattgcttcgcgcccaacgctgctgagtagcgatcaacatgtgccgagtgactctattgcgctgttttctgagctgctgaccgaacataagctcgacagtgagttggatgtgcaggtgattccagcaacggttttgtggggacgtaaaccgggcaaagaagggcaagaaagaccctatttgcaagcgttgaatggtccggagaaagcgctggccgttttggcttctggccgtgactgcttggtgcgttttagtcctgtggtgtcgatgcgttacatggcggacacccacggcaccgatgcctcgattgcccataaattggctcgtgtagcacgcattcacttctctcggcaaaaactggcggcgtcaggccctaatttgccgcagcgagcacaactgtttgcccgcttgatgaattctcctgcgattgaaaaagcgattgcggacgaagcgaaatccaaacagatcccacttgagaaagcgcgcaaagaagcgcacgacattctggatgagatcgcggcggatttttcctattcgctcgtgaaaaaaggcgatcgcattttaggttggttgtggaaccgcatctaccaaggtttgaacatcaataacgccgcaacggtgcgtcgcttggcgcaagatggccatgagattgtctacgtgccttgtcaccgtagccatatggattacttgctgctttcttatgtgctttatcatgaaggcatggtgcctccgcacattgccgcggggattaacttgaactttttcccggcggggccgattttccgccgcggcggcgcgtttttcattcgtcgtagctttaaaggtgcgccactttattcaacgattttccgtgaatacctcgcggagctgtttgcgaaaggctattcggtggaatacttcagcgaaggtggccgctcgcgtacaggtcgcttgttgccagcgaaaacgggcatgttggcgatgaccattcaagccatgttgcgtggcctgaatcgtcccgtcacgttagtgcctgtctacatcggctatgagcatgtgatggaagtgggtacttacgccaaagagctacgcggcaaacgtaaagagaaagaaaatgccggtttagtgctgcgcacgctgcgtaagctgcgcaattttggccaaggttacgtgaacttcggtgagcctatcccactcaaccagtttttgaatgaaaccgtaccgcaatggacgcaagatattgacccgatgggcgagagcaagccgcaatggatgactccaacggtgaataaactcgcgaaccgtatgatgacgcacatcaacgatgcggcagcggtgaatgcgatgaccttgtgtgcgacggcgctgcttgcttcgcgtcagcgtgccttggcgcgtgacaacctgattaagcaggtggattgttacttatcgctgctacgcaatgtgccgtattcagccacatcaacgctgccgagtgagagtgcagagaagctggtagaacatgcggagtcgttggataagtttgtggtggaaaccgataccatgggcgacattatttcgctggatcgtaaccaatcgatcctgatgacttattatcgcaacaacattatccacctgttggctctgccatcgctgatcgctcagttgttgattcgtcagcaaagcgtatcgctggaaaaggtgcaagcgaccgttgcacaaatctatcctttcctgaaacaagagctgtttttgcgttttgaggcagaagaactcaacgatctggtactgcgttatgtggcggagctagcacgccaaggtttggtcacggtggaagggaaaaccgtcaccctgaatcaagcgcaaactcaagtgctgatgctgctggggcgcattatctccgaaacgctgcagcgttatgcgattgcgctgaacctgctggtgagctgcccacatttgggtaaagctgagctggaagagaagagtcaggaagtggcgcagcgtcttggccgtttgcatggcattaatgcgcctgagttctttgataaaggggtatttgcttcgctgttcgtgacgctacaagagcagggatatctcgatgatcaaggccgctgcgtattagaaacagcgaagccgctctctcgccagctttatgcgctgatctacccagaagtgcgcatgacgattcaagaaagcttgtgtcaggttgacgcgtaacgattgtgttctagccaatcgaaccgaatgaaaaaggcatcctgcggatgccttttcttttgccttaagctgggattaccaaacgctgagcagaatgcctgcggtgatggccattcctacatagttgttatttaaaaacgcctgaaaacaaggcatacgttcgcgataacggatcaaatgttgttggtaagcaaacagccccgctgcgatcagtagaccccagtagtaactggtgccaagcgctaaaccttggcctagagcgaccagtaaactcaaagtggccaattgcagtaggccaatgatgcgtttatcccaacgcccgaataagatcgcggtcgatttgatgccaattttcacatcatcatctcggtcgaccatggcgtattgagtgtcgtaagcaatcgtccataacgcattaatcaaaaacagtacccagacttgtggagtcagcgtatttgcttgagcagcccaagccataggaatcgaccaactgaacgcgaggccaagcaccagttgaggcaggtgagtgaagcgcttcataaacgggtaaacaaaggctaacagaataccgataaaagagagctggatagttagggtattcatagtcaacacgagtaagaacgagctgacagcaagaagaacaaataacagtaaggcttctttggccgaaactaaccctgcgggcaatggacgttggctcgtgcgcttcacatggccatcgacatggcggtcggcgtaatcgttgatcacacacccagccgagcgcattaaaaaaacccctaacacaaacacgactaagacgcgaagatccggcaagccttgagcggctaaaagcagcgcccacagagtaggccaaagtaagagtagggagccaatcgggcgatccatgcgcatcagttgccagtaagcgcgcgcttttacagcggtcatttacactctctccttagagtaaatcggggatgtggcgagaaacagctccgtcactaacatgggtttgttgttcatccataagcgagagcgacgggctaatagtcgtccgagttctgtctctacccagccaacttgcagtgcatctcgcttaacattatccgcactaaatacggtgagacctagtggaattttcccttgttgggtgaaatcaaacggctgattgtgcatggatgagcgagggatcaaagtatggccaaatacccaaggttgttggtcgccataaataatcacttggcgtagaagatactcttcagaggcgagcagttgagtttcatcatagctcagggtgtccgccagcatgatttggttacttaataaatctacggtcagatgctcacactgcgtcgccattcggcgcgaaagagagccttgttcgagtagccattgctgagctaaaggggctggaaattcaatgtcatcaggctgttgccaagtgacgcgattcagtgcggctaaatagagcgaagttaattgattcatactattattcaatttgacgctttacccgattaccctagctacctgcaataccaccgagtttgggtatacaataaagctcagattttgattccaaaccaaagagttcgaacgcggaaagcattttatttaccaaatggatgctctattgtaacaagactccggcggttcgagtattgcgaacagaataaagagcagacagaaatatgctaaaacgttacgtcgtccaaataatgctcgctttgagcttcattgttcctttccatagccatgcggaagagaaatctgctgtacctcagttggcttatttcactttagaacctgatctcaccaccaatttttttaccaaaggtaacaaattgggttatatccaagtacggatcgatattatggtcgccaatgctgcagatctccccgttgtggagcagcatcaacctttgattcgtgatgccgtggttgagctgctcggtaagcaaaccgaagacaccatcaaatccttagcgggccgtgaggatttgcgtaagtcgcttgtcaatcgcctcaacaacatcctgttgccagaggtagggcgtactgtgatcgcggatctgctgtttacgaaatacatctaccaataatcggattgtgttgggtgcatcgctcagcgacgagtcagtaaacaaaaaagcggcggttgccgcttttttactctcagagtatcgatgtctgctgcatcatggtttcatccaacccaggctcaaaaactctcccattcttcatcgtgcgcgacctgcataacgggttgtgccctcgagctggctttggccgtgatttttgctggcgttttagcgatgtggctggccggatgtcgagtcactggtgcggattgcgggcgcttattgaccgctttcaacagtgatggggcgctcgtgtcctgatctggcaatctgaacatagcgacatggtcatagagctgctcggcctgtgctaataggctttctgaagccgcggctgcctcttcgacgagtgcggcattttgttgggtcatctcatccatctgattgactgcttggttcacttcattgatccccgttgcctgctcggctgacgctgaggcgatatcggccatcaaatcatggactcgcttgatcgacacgactatgtctttcatggtgctgccggagcgatccaccaattcattcccattgctgattttactcacggaatctgagatgagcgccttaatatctttcgctgcattggctgagcgctgtgcgagtgagcgtacttcggaggcgactacggaaaatccgcggccttgttcaccggctctagcggcctctaccgcagcattgagtgccagaatattggtttggaaagcaataccatcgatcacacctataatatcggcgatcttttgcgcggattcgttaatcgaggccatagtcactaccacttgctcaatcagttctccaccgctggcggcgatttccgtggctttacccgcaaggatgttcgcctgcatggcgttatccgagttttgtcgcaccgtgctgtttagctcttccatgctggaggccgtttgctccagattggaggcttgttgctcggttcggctagagaggtcggtattgccattggaaatctccgtcgctgctagcttgatggtcgcggcgacgctgttgatgtcagtaatgatttgacgcaatgtgacaatgaattgactgatcacctcaccgagctcagcaaattcaccttcaaaaggatgcgtgagttgtgcactgagatcgccgctggagagcgccgtcatgacgcgtttgacttcattgaccaccatcttacgctgagtcacgttggtggcatatttgacaaccttatacggtttaccctcgctgtccataatcgggttatagctggcttggatccagatctctttcccccctttgccgaaacgtttgtattcgtcgacaaagaattcgccggagcgcaaacgctgccagaaatgttggtactcttgactctgtttatactgctcatcaacaaacatgctgtggtgccgcccttggatctcatccaactgatagcccaccgtttgcagaaaattctgatttgcagtcagaatggtgccatcgagcgtaaattcaatcacggcttgggtgagattgaccgcattcatttgaccactacggtcaattttttccagcttggccgcagtgatatcttgcaacagtaccaccacgttttgtaattgaccgtttatcgccttgatgggatacagatccgcttttatccagattgcctcttgcgagcggctgagctgtaattcggcagaaacagggtgtccttttttagcatcctgcagcaagcgctgcacagatggctgctgatgagtgcgccataagttcgcaaaatccgctccgaccatcgcttcagccgatacccgacagagatgagcaaacgcatcactggcatagcaaatcgtgccgttgggctcacattccaacagtgccagatgttcacgaatcacctgaacaaaagcttgattgacttggggtgtgaggtctgactctggcgtggtgagcgcaaggtcagtttgataaggcgcaacctgtggttctggctgtaatgccgtcgtctcggtggttaccggagattgcatcagcgggtctggcttaacctccgctggttgcgtcggatgatgtggtgctgtagagaaaagacgtgccaataaacccataacctgctctccttggatgggaccaactgatgtttttatttcccttttctacttgaagcggtcacgctggatgccgtgttcgtttcgtccagtcacagagtttatctatgcttgtaacgatggtctcactggccctctgccgtcgcagcaagttgttagggcatgcgatcattgatcgcgtgatcttatggcaacactaaggcacaacgcagtcaggacagcacagaactgacaagcattatgttgcacattcgatactaactcatagcagaggttgggtgattagtacaagtcggtgagccgttttacgatcagcatacgtgctgaccgtgatcgcgactcaaagagaagcggcgcaagaaaggaggaaatgcttaagcttgctggtcgcgctggctgtcgaaccatgccagtacgacaccgctgattaagccagctaaatgagcggtattggcaatcgccataaacggctgcacataacctaacactaaccagatcagcataaagcccatcaaggatcttggaatggataaacccagttggggggcgcgctgaccaagaatccacagatacccagccaaagcatagacaacaccggataggcctccaaaattcgcgccttcaacccagtattgaccagctccagagataatcgcggacaccacaaacagcttaatcagtctgacactgccaaggcgctgttcaagatcgcccccaaattgccaccaccagagtaagttaaaggcaatatgcatgacggaaaagtgcagtaaagcatgactaacccagcgccaaatttgccattgctggccagcaagagcgggaaaatgtaatgcattaaacacctcatctcccgcaccaaacgtttgcagagtaaagatgatgatgcatagcgccataataaacagcgtaaacactccagctttggctttaatcagactgagtaaattgggcgatgcgtaatgaaattgggggcgcttttgatcagcgacttcccatgaggcggcttggtatttttccgcataagggttctctaaaaacagcgcgagttcagcttgtgcggtttcgatgtgttgatcttggattacccaaagagtgaactgaccacctgcatccggcatcatctgaatttcaatgtggtgggcggccatgtaatcgataaaagcttgtgccgcacgcggattgttaaaagtggtcagtaaatgcattagtccttaactcgcttcgatggggagattggcacgatgccaggcttcaaagccgccatcgacactatacacctcttcaaatccttggttaaccagatattgggctgcgccttggctacttatgccgtgataacacatgactaaaaccggctgatcaaactcagcttgttccatgaattgcaccatagactggtttgtcaggtggtaagcgtttttagcatgagcgagttgaaaagattgtgggtcgcgaatatcgactaaatgagcctgtttctgctccatcatggcttgtgctgcattaacgtcgatgtgtaaaaaatggtccataggtttgctctcatttggcatgccgaatcgggctaattgtaacctattcaagtttagacaagtactggacaagagtagggttatccacttgtgattaaaatgacagcacctgtgggtaatcctgtgaattgcgttgataaagtggttttgtgattttcgatccacaatatgtagcgatgatcctgattttgctgtgggtaattttgaaagtatccccaatcgatgaattgtaataaagccttgaaataggcggtttgatgacagtgaataaagaaatttatcacagagttatccacaggtagatttgcgcaacgagatcccgagtgcgatctaaaatcggatcactgcagcgcaattgaacgtttgagtggagtctttcgtgggaagtcacaggaagggggaaaggcacaaacccagaatgacctgcacgggcaagtcattcgctcacttatcgaagcttgattgacgatgagcttagtgcaaaagagaggctaataaggccactatgctctcacagcaaagcagccactatttgatcttgatgatatgtccgcactctctgcagatgtagacttctttaataccaatcagcttttgccacagtgtgcgccgtttacgttgcaaatgattcgtgtgagtacaattgagcataatatataagttaaccatgaaaaattgttacgaatattacatttgctgcataggaaatgaaagtgatcttggttcaataaaatgctatgaaattaaattaataaaactgtcatttatccagtccaaacaatgccttagaattgttgttggtaattttgataacctcgccgagagggagtgaacgaagctgtgcaactttctcactgatgagatgggttaacataggttcattacgttttccacggtgggggacgggggctaaatagggacagtccgtttctaaaatcacgtagttgagatcgagttgcgggatcacttgatccatgccgctatttttaaaagtactgactccgccaatgccgagatgaaaaccaagatcattgatcgcttttgcctcgtcgacactgccgccaaagcagtgaaaaacaccgcgtaagcgaccatcttgcgcttgcttgagtaatgctaatgtctcgttgagcgaatctcgggtgtgaatgaccacgggcaaatccagctcttttgcccagttgagttgggttaaaaacgccatttcttgttcggctttaaaagtcttatcccaatataggtcgataccgatttcgcccacggcaataaaagtgtggcgagaaaaccactcataaatggtcgctaaagtctgttttacattggcatccacatagcaagggtggagtcccatcatcgaatggcaaagatctgggtaggctttttctgttgccaacatgggcgcaatggaattgaggtcaatattaggcatcaagattttttcaataccgacttgtctagcgcgagcgatcacctcatcgcggtcatggtcaaattcactggcataaacgtgggcatgggtatcaatcatcggatcatctcaacattcggttttgtggcgagtatacgtgagtgtgagcacgaggtcatttttggctttttcctgctttgccgctagcatgccgagccgagagtgatatgattttgcccagcacttccctcagcacctgatttttcaggcactgaccacataagaaggagaatagagtgtcggtatccattcaaggtcaatttcctgggcgtcgtttacgccgcctgcgtaaacatgatttcagccgtcgccttgtggccgaaaaccagttgtcggtgaacgatctgatctacccgatgtttattttgatgggtaaagatcgccgtgaaaaagtcgattccatgccgggcgtagaacgtttatccatcgatttaatgctggaagaagcacagtatctcgctaacctcggtgtgcctgcgattgctctgtttcctgtggtcaatcaggatgcaaaaagcctatgtgctgccgaagcttacaaccctgaaggcttagttcaacgcgcagtgcgtgcgctgaaagagcatgtgccgcaaatgggcgtgatcactgatgtggcattggatccattcacaactcatggacaagacggcatcatcgatgagcaaggttatgtgttgaatgatgaaacaacggaagtgctagtgaagcaagcactgtcgcatgctcaagctggtgcggatgtggttgccccttccgatatgatggatggccgtattgggcgcattcgtcaagcattggaagaggcggggtacattcatactcaaatcatggcttattccgctaaatatgcctcgaattactatgggccattccgtgatgcggtcgggtcatctgcgaatttaaaaggtggcaacaagaaaaactaccaaatggaccccgccaattccgatgaagctttgcatgaagtcgcgatggacatcaatgaaggtgcggacatggtgatggtgaagcccggcatgccctatctagatgtggtgcgccgtgtcaaaaccgagttgcaggtaccgaccttcgcttaccaagtttccggtgagtatgcgatgcacaaagcggcaatcatgaatggttggttgaaagagcgggaaacggtattcgaatctttactctgcttcaaacgtgcaggtgcagatggcattttgacttactttgcgaaagaggtggctgagtggttggcggaagacagcgcaaaagccgcgcagttcttacctaaaaagtaaagaatacaccgcgctaataaagcaaagctcaaggctgacgtaagtcagcctttttaacatctctaaaccactgtttttagcgatggcgattgtttgaggaaaaatgatgttaattcgtgaaggttccctgagtgaaattgtacaaatcgttgaaaaaattcatgagtttgcgcagaaagagacggaacagagcttacaagctaggctgaacgataagacttgcttagtgctcgttgcagaaaatgagagcgaattgctaggttttaaaatgggttacgagctcgataataaaacgttctacagctggtttggtggtgtgactcctgccgcacgagggcatggtgtcgcgcagcgcttacttgacgtgcaagaaaaatgggcgttagagcaggggtatcaacgtatcaaagtgaaatcgcgtaatcagtttcccgccatgttacggttgttgataaaaaatggttatctcattgaggattatgagaaaaaggaatccatcatcgagagccgaatccactttgttaaagtgctctaaaaaataaatgagattttttctcatttgggtgttgactattaaatgagaactattattattaaccacgtcttagggaacaagtgaaggttcaccaggacgttaagtcaccctttatcgagtcatcgatatgcggtagcgaaacggccgaacttgagcaggttctttttgacacgacattgctcacattgcttccagtgtaatttttagctttttggtaaagcgaatcaaaaaattggctttgacctcgtttgctaggcgacatcttcgggtgtcgctttttctttttatgttatggttctcgctctcgctcatgaagttatccactgaagcttaatattatcccagcaatgagtggacaagtatgaagtttcactgcactcatccactggccaatccatcacgtaagcagagtgagcaaaagggcagcgagtgtcttttccacaatttacgatccgcaaaagatcattttattttcagtcgatccttttttttattgtttaaaaacattaacttaaaaattaatcatgcagtaaatttatcggttgtaaatcgacataaataaatctataaacagagttatccacagaatgtagggttggataagtgggtcggatatcccctgaatgagccaaaaacggtaacaacatggaatccaagcattagtcgtggcatcctaggctcatttacttacgtttggataatccttctatggctcatatacctgacaatccattgattttgatcgacggctcctcttacctttatcgcgcatttcatgcttacccgggcaccatgagtaatggtgaaatcccaaccaacgccatctatggtgtggtaaacatgattcgcagcatgatgcgccagttcgcttcggatcgcatggcggtgatttttgatgccaagggaaaaaccttccgtgatgagatgtacgatcaatacaaggctcatcgtcctcctatgccagatgagttgcgctgtcaggttgaacctttacaccaagttattcgcgctatgggtttaccgctgttggcgattgaaggtgtagaagctgacgatgtgattggtacgttggcgcgccaagcctcacaagctggtatgcctgttttgatcagtaccggcgataaagatatggcgcagttggtggatgataatattaccctgatcaataccatgaccaacgtcgtgctggatcgcgaaggtgtgattgaaaaattcggtatcccgccagagcttattatcgactacctcgccttgatgggtgataaagtggataacattccgggcgtacctggggtgggtgaaaaaaccgcgaccgcacttttgcaagggattggcggcttagaagcgctgtacgccaacctcgataaaatcgctgctttaggcttccgtggctcaaaaaccatggcacaaaagctggaagagaaccgcggtaatgccaagctttcttatcaactcgccaccatcaaatgtgatgtcgagcttgaggaatctccgcaaaccctgctaaagcaaacgccagatcgagatgcgttgatgtcgctctacggtaagctcgcctttaaatcttggctgaccgaattgcttgatggtggtacaggtattgtgacggcggacgagcaaacgaaaacctcttcagttactgtttcaaccgcagcaactcatgcggctgcgattcctgaaagccctgcggcccacatcgatcgcagccagtatcaaaccatcctaaacgaacaagacttccagctttggttagagaagttaaaacaagccgagctgtttgcctttgatacggaaaccgacaaccttgattacatggtcgccaatttggtggggatgtcgtttgcagttgccgaaggtgaagcggcttatctgccagttgcgcacgattatctggatgcgccgcagcagttggagcgcgactgggtgattgcccagctaaaacctctgcttgaagatgaaagcaaagccaaagtgggccaaaacctcaaatacgatgcgagcgtgatggcgcgctacggcgttgagctgcgtggtattcgccatgacactatgctgcaatcctacgtctataacagcgtgggcggcaaacatgatatggatagtttagcgctgcgttttttacagcacagctgtatctcgtttgaacaagtggcaggtaagggtaagaaccagctcacctttaaccaaatcgctttagaagaagcggcacaatacgcggcagaagatgcggatgtgacgttgcgtctgcatcagcgaattcatccgttgattgagcaagacgctaagcttgagcaagtgtatcgcgaaatcgaaatgccgctggtacctgtgctatcacgtattgaacgtacgggcgtgatgatcgacgacatgctgctcagtgcccaatcgcaagaaattgcgttacgtttagatcaattagaacaaaatgcttatgagttggcaggtcagccgttcaacttaagctcgccgaagcagctacaaaccattttgtttgagcagatgaagctgcctgtcttgcaaaaaacgccatccggtaccccttcaaccaatgaagaagtgttgcaagagctggctttggattacccactgcccaaggttctgattgagtaccgcggtctggccaaactcaaatcgacctataccgataagttgccgaagatgattaacccaagtacagggcgcgtgcatacttcctatcatcaagcagtgacggccactgggcgtctctcctccactgatcctaacttgcagaacattccagtgcgtaatgaagaaggacgccgtattcgccaagcgtttgttgctccgcatggttggaaaatcatggcggtcgactactcgcaaatcgagctgcgcatcatggcgcacctgtcgggcgatcaggcgttattggatgctttccgtgatgggaaagatatccatgcggcgacagcagcagaaatcattggtgtgccgattgatcaagtgagcagtgagcagcgtcgccgagcgaaagcggtgaactttggtttgatctacggcatgagtgcgtttggtctggcaaaacagctcggtattccacgcggtgaagcacaagagtatatggataaatactttgagcgttatcccggcgtgatgcagtacatggaagatacgcgtagccgtgctgcacaattgggttatgtcgaaaccatcttcggtcgtcgcttacatttgccggaaatcacctcacgtaacgctatgcgtcgcaaagcggctgagcgggcagcgatcaacgcaccgatgcaaggcaccgcggcagacatcatcaaaaaagccatgttgttggtggatgagtggattgagcgggaaggtgatggccgagtcaaattgctgatgcaagtacacgatgaattggtctttgaagttaaagagtcatctttatccgaaattgaaagtaaagtacaacagctgatggagtcagcggccgagcttgcagtacctttagtggccgaagccggccacggcgacaactgggagcaggcgcactagctcgattttccagcgaaactgaagaaatacatgagccagcgcacgttcgctggctttttttatcactaaaaaagtttacctagctcagacagttatgttgtttaactaaaatttaatgaaaaaaaactacaaaaaatattttcaattctgaccaattgttgtacattagctcgcgtagggtacagaggtaagatgttctatctttcagaccttttgtttcacgttattggattaggctgattcagccgccccagtcaccatttgactggggcgttttttattgggcgctattccacgttggcactcccgcttttagcctatatctctgcttattttgtggtcggtcgcttatgtgctttaagcggattgattcgacaaaaacactccattctgtaactaaacaccattcacacttttattatttctaacgagaaatcaagtctctaaaacacagcatttaagccgtcgaacgatgctgaaagccaagagcagcaagggttaagctatcttgagtcatctgatcttgagcattttgtgccgacttgaaaaagagccgcgtttgcgaaatgcttgggccataacaataaaaaccgttttctctcccgttgccccaccaggatggtggggattttgttgctttccctcatatttgttggcctaccatcgacagccctgagtgacatctctgaattgtggtaataaaaaaccccgcatgagcgaggtttgtcgtgacatagtgttaagactattggtcggtagacgattcaggctgctcgccttcttcttgttcggcaagagctgccaacatcggtgcataccactcatccagtttggcgcgcagagtatcgacaccaattccgcttaatgaagagaaagcatcaacggccacatcgccaccaaaggtttttgcctcttcacgcactttcaatacttgtgctttacgagcgccactttttagcttatccgctttagtcagcatcacctgtactggaattccgcactctaccgcccagatgatcagttgctgatcgaggtctttcatcggatgacgaatatccatcagtaccactaagccttttaggctttggcgcttttgtaagtattcaccaagggctcgctgccacttgagcttcatctctagcgggacttgagcaaagccatatccgggcaaatcgacgatatgacagccgtctgctactttaaaaaggttaatcaactgcgtacgacccggagtcttactggttttggccagatttttctggttggtcaggcgattaagggaacttgacttaccagcattagagcgtcctgcaaacgcaatttcgataccttcatcttcaggaagatggcgaatatcaggcgcactggtaatgaaatgcgtgttttggtaatgaatttttacgctcactgtgttaactccatctcgactttgtgtagtcgattgattacttttttgtgaaattgtgtaaaataaccgtgctcggcataaggtcgcctattgtaccatgagaggtaccccagagtggtactggaagcttgataattataaatggaatgtcatgaagaaattagcgctaatcttgagtgttttagccagctgctctgtatgggcccaaggtagtatcgaagctggtaaagccaaatctctaacctgtgctgcctgccacggtgcagacggcaacagcccgttaaccatttaccctaaactggcagggcaacatgagaagtatcttgagaaacaactcaaggaactgaaattgggtgcttccagcggcggaaaacagggccgttatgatcctgtgatgagtgcaatggcgatgccactgagcgatgaagatatcgctgacttggcagcatactatgcctctatgcctatctctggcaataccacaccggaagatgtcgtggcccaaggtaaagtactttataccgctggggatgcatcacgtgggctgaccgcttgtattgcgtgtcatggtccgcgcggtaatggtacggagttatcaggctttccaaaaatttcaggccagcatgctgactacattaaagcgcagctagaaaagttccgttccggcactcgtgcgaacgatatgaacgaaatgatgcgtgatgtggcacataagctgaccgatgcggatatcgatatcctatccaaatacgtaggtggcctacactagttagacaaaacgagcaaagatgactaaacagccctagtgaccttactagggctgttgctttttatggcttgcccacctcttttggggtaacgcatcgaacaattcagcgttttttgtttaggctgatgagaaaatcgccttttacactccactctcaaggcagtttctggtatgttgcgcatcccgttggaggaggtcagcatgcatctatgcccgttatgtcacagtgaaaatagccaagcgtattttgctgataagcagcgcgactattttcaatgtcagcagtgcgaactggtgtatgtaaatcctgagcaacgcttaagtgcggagcgcgaaaagggcttctatgacttgcatcagaatattccgagtgatgagggctatcgacgctttttatcacgcgtctgttctcctatgcttgagagagtgcctccccaatcacaagggctagattttggctgtgggccgggtccaaccttgtctctcatgttagaagaggcgggacacagcatggcgttgtacgacattttctatcatccagatacgcaagtgttgaaccgtcaatatgattttatgactgcgaccgaggtgattgagcatctgcacgatccgcaccgagtgtggcagcaatggttaaatttagttaagccaggcggctggattggtctgatgacaaaaatggtcaaagacttagacgcgtttgctggttggcactacaagaatgatctcacccatgtgatcttttttagtcgtgctacgtttcagtatctggcggagcgggatcagctcgaacttgaatttattggtaatgatgtaattttactgaggaaaacccagtaatgagtcgctcaaaaaaatcgagaaaaccgggtaccaacagtaacgatcaactggtcgtggtacgtacacgcagcgaatccgaattggaaagccgcctgcgtaaaaaactgaaaaagcgtaaaggcttaaagtcaggcagccgccattcagaaggcagtgaaagccaagtgcgccaagcggcgcaaaagcgcgacccgcgtttgggtagcaaaaagccgattccattgattgtggcagagccgaagaagctcaataagcaagagcgcaaactggcggctgagcaagagctagcgatgctagagaaagacgcgcaactcaacgtgctgctcgaccgactcgacaacggcgaaaagctcgggattggcttgcagaaatacgtggatgagaagctggatcgcattgaagtgctgatggagcagttgggcttgctcgacgatgaaccagagccagcgccggcaccacagtcaaaaccgactaaaaagcgcaaaactgaagacgatctattgtctgagtttgagcagctggatgtggataagtaccaagattaaggagcggtgatgaacgggatgctactggctagtgtgggcggtgccattatcgtggcattggccagctatgcagcttacttgctgtggcaagtgaaaaagcagcaggcgctacagcggcaacagcaacagttagcgattgaaaagcgtaacgccaacatctttgacagcgttaatatcctttgtatggcggggattcagggacagtgtgatctctctgaaatcagtatccgcgtctattgcattatggattacgtacaaggtgagcagcgcatcaattttgaacaagagtatcccgccatcagcgagctgtaccatgtggtgaaaaatatgccgcgtggtgaagcgcgccaacaactccccaagcaagagcggatgaaacagaatctggagcgcaccaaagcagaaagtcgtctgcaagatgcgatcattgtcgaactcaccgctctcaagcagcgcattcagccgctgaataatcaaatcgcgattcagatggtgtgaaactaacccgaaagggggagtgatcgcgctagcagaatcgaatattttgttgccagatcctgttctgccgcccgacgttcgtcaatgtcgtgtggcagaatagcccgtcaagaattgagcaaaacggaaagattcattatgtcgtcgtatgtcgtacccagccaacagatcgtatgggatcaggccattctggataagtacaactactccggtccgcgttacacttcatacccgactgcggttgagttccatgaagcctttaccatcgctgactttgatatggcctgtactcagtacccagagcgaccattatcgctgtacattcatatcccgttttgccataagctttgttactactgtggttgtaacaaggtgatcactcgtcattcgcacaaagcggatgagtaccttgatgtgcttgagcatgaaattcgtcaacgcgcctcactattaatcggaagaaacgtcactcaactccacttcggtggtggtacgccgacgttcttgaccaacgctcaaatcagtcgtttgatgacgctgctgcatagcgagtttcacttcgccgatgaggcggaaatcagtattgaaatcgatccgcgtgaaatccagttagaggtgcttgatcacctgcgccaagaaggctttaaccgagtcagcatcggggtgcaggatttcaataaagaagtgcagaagctggttaaccgtgagcaagatgagcagttcatttttgatctggttgaacgcgctaaacagctgggttttcgttcgaccaaccttgacctcatttacggcttacctaagcaaaccgcagtaacctttgcccagacgttgcaacaagtgctgaccatgcaaccggggcgtttgtcggtatttaactacgcgcacatgccgcaactgttcgcagcgcagcgcaaaattaaagaagccgatttacctgccgccgaagaaaaactggcgattttacagcagacaatcaccacgctaacaggcgcggggtatcagttcatcggtatggatcactttgccttgccggatgatgagctagcgattgctcagcgcagtggtatcttgcaccgtaacttccaaggctataccacccaaggtgaatgtgacttagtcggctttggggtttcggcgatttccatggtgggcgatgcctatgcacaaaaccagaaagagctgaaaaaatactatgcgcaagtcaatgagatgcgtcatgccttgtggaaaggtgtgacactagataaggatgatttactgcgccgtgaagtgattaagcagctgatttgtaatttcaagcttgataaaacagcgattgagcgtgagtttaatctgcgtttcaatcactacttccgccaagatttagctctgctacaaacctttatcgacgatgggttggtgacggtggatgaacgcatgattgaagtgacgctgcgtgggcgtttgttaattcgcaacatctgtatgtgttttgataaatacttgcgtgagcgggcgcgtcagcagcagttctcgcgagtcatttaagaccgcattccacaacaaggccaccgcatgcggtggccttgttgtttgtgctctgattttaattcaggatgactgagcggaaggtgactccagcaaagagagcgctttacgagaaacatcgtgtgcggcacgcgtgaaattctgcttttccagtgcatcagccaaataggcatagtcggagacgctagagcgcagtgacagcgctttttcgagatgtttctgcgcatcagcccaatgtttctcacgcagatacagttgacccaaagcgctatgtgcttcggcattattgccatcccgacgcagcgcttcttgcagcaaggcaatcaggggatggcgatcgctgatattgagctccggcagtagcgcgtacagctcaggagtcgcttgtttcttcaagctctctttgatcattgagaaggcctcatagtcagctttgcgttgaataagctgagtgataaagcacatcaaaagttccggctccgctttcagtttacgtgacagctgagcccaatgttgcatcaagccttcactgccttttgggctggcaatgtcttgcaaaatgccacgctgagcggtgatttccagttgctgcgcttcctcattgctcagacgtttcgctttgaccagtttgggcagcaaggccaacagtggttgccactcgccaagggcttgataacactgcttgagcaagttgagcaccaccgtattgtgcgggtgattgcgctgcagttgagttaaggtttcaagggcagcttggttatcgccatcacccagttgttgtttggcgcgtgtcagctccaccgccaaagtcgagttattttgctgagcggccagcgctaagtaacgatcgcgcttagctcgatcgcccataccattggcggcttctgaagcgacaagatagcaaagcagcggcatatcgtggtgattggcccaacgagtcactttcttctcggcttgtgtccaatcgccttccagcagtttgatgatcccttcattggtataacggcgtgagcgacgctgcttacgcacgctaaaccagttccaagtgtgaaagctggtgtagaggatttttttcaccaaaaactctagagcgaacagggcagccaatgctccaatgataaaaatcactaaagtggtgacactcatttcaatggtgcgattggcgatcgagatcagcacatagccttgttggccagcgtattgcgttcccacaaacaggccaagtcctaagacaacaaagaggaatatgagacgaatcattgctcagcccccgtggttagtggtgaaacactgcggcgcaagcgttcgttgatcacatcggcgagctgttgctgagcctgtaatttaacggggtattccacttgcacttgctgctcggcgagctgggccaacgctgcgttaaagctttgtacggctttatcgtctggattgaagaacgatgttgaccactgggcggctgtgtcgagagcgatgcgatagagtgtttgttgttccgtgtacacccctttgatcgccgtttctaacttggcctgcagattctctcgcaaataaaaatgctgagtaggagagagaagagggatcacattgccatcacgtgagcggaaagtgatgaagttatcggcaaacgctttgagcgaatttttcaggttggtttgccagtcatcgatgttttctgataccgcttggcttgtttgtggctgatcggcaggcaagatggcattggccagcggtaagctatcgatctgctgttgcaagctgatgaggcgcagcactaagccatcgcggtcaatgagcgggatatttttcagggtagtgatgtcattggccatcgctttacgcagcgccgtgaggctagggtcattaagcgcagcgatgcgctgatcggcactttccatcaattgagttgcggtttccacatcgtgctcaagaaacagcttgcgacccgcgagcttgaccaagtaatccgcttctgcaagtagccaatcatttgggcgacggcctttaatatccgccacggcgagctgcaagctttcaatacttttttgttgctgttccagcacggtttctgcgcgatgagtaatctcagtggcttgtgacgtggctttcgataccgtttgttccaactgcgcattgagcgcatcacgagtctgtttcagctctgcgcgtacggcttgcaactggttgttaaattcacttttttgctgctgatgcacataggcaaaacctgcgccgagcgctaataccagcaaaagcgccacgctcgccaactttttcccttgcgagtttggttgtggcggcttgtcttgagctggtgtgctgtccaaggttttcttggccgccggttggtttggcgctgggctatcttgtttgtcgggcgcggtcgggggagtcaccgctgccgagcttgggtttactgtgatttcaggttcttgttgcggtttattgttgttggtcattgctcagagttcctgttggtttttcgggcatcaatgccgcgactaaatcgcgattagcagcacttagcgtgaccacgatgcgatgaaatcctagttggtgggcgagagtggcaatccgttggctgggtacgagcaaagttaactgctgcacccatggcaagtgtgatgtctcgaactgacggataaaaaaagccaactgctcactgctggtgatcaccagtgagtcgaccttcgccaactgccatttttggacacactcggcggcggcaaatggccgctcgtgccgacaatacgcttcttgatagcgcacagtcgctcctctttccactaaggtggaataaatcagctcacgaccaccattaccacgtaagatcaataccttcttacctgcgacatcacgcagcatactgagtgccagcagatgttcactatcgcttatttctggatagtctactgattgttggcaggctttgctgaaaacatgcgcggttttttgaccaacggcaaggtaaatagcgttatttggccaacaaattcggcgatgttgcagaaattggtcactgaagatgacggcatgttgactgacggcaatgatgatatcgaatgaagataaatcttctgccagcgcagcaagttgagggctggcagagatggcgagtagcggatggtgcagggcggggatgccctgctggtgcagcagctggcacagctctgcgccttgttcatcaggacgagtgaccagtactgtcataacactctcaatcaatgcgagataagcaatcagtctatgcgtgcggacataggcttaccattattcgtggtcacagtagagacgctccaagatctctttggctccttggctaagcagttgctcagccagcgtgatgccaagttgctcagcttgtgtgcgaggtccgcgaatttcgccgcgcacgatttgcgaaccatcgggttcacccacaagagcgcgtagccaaatagtgtcaccctccagcagtgcatagctaccaatcggcacctgacagccaccttgtaacgtgagattcatcgcgcgttcgcagcgcactcgatcggcggtatcagcatggttaagaggtgcgagtagggcgcgcacgcgttgatcattcacgcgacattcaataccaacggcaccttggccaactgcaggtagggactgttccggttcaataaagctacgaatacggctttcgagctcaaggcgttttaggcctgctgccgctaaaatgatggcatcgtattcgcccgcatcaagcttacttaggcgagtccccacgttgccgcgcagctctttaatcactaaatctggccgtgccgctttgagttggcattgacggcgtaaactgcaggtaccgacgatagcgcccgagggcagatcttcaatcttggcgtaggtatttgagacaaacgcatcacgcggatcttcccgttcgcagatggtgactaagcccagaccgtcagggaaatcgaccggaacatctttcattgaatgcacggctaaatcggcgcgcccttcgagcatggcaatttccagctctttcacgaataagcctttaccgcccactttagccagtggagtatccagaatcacatcgccgcgcgtgaccatagtcaccaactccacctgcagtccggggtgggctgccattaaggcgtctttaacatagttggcttgccacaaagccagtggactctggcgggttgcaatgcgaatcggcgtctcggtcattatgatgttcctatccatctgttttaaaatcgcctaatcctatcacttggggcttaaaatgcttacaactagttcgagtcggaacgattttgcgcagaagaatgtcgttttcccgcttgattgtgtgattcgactcgcatttattatcttggcgatacttacaaaacggcaatttgcaacaacactgtaatcatttatgctgttttgtgttgataagtgtttagtttggtgtgatgtgcttccaagagcgctttaccaaaccggaaagaagtgttagattgatcacgttttgttggcatggtcgcgtaaaacataaccaaaaagcggcttttatctgtcatatcagggaagcaaacttgcaggcttatactcagaccttaatccatagacttgataagctaaaccggcaacgtattgagcgtgcgctggctcttatggatttgcaaagtcaacgtgttttccacctcattcccgcactatttcaatttaatcatcctctgatccccggttatttttctgctgatacgcctttcggtatccatctgtttgaagccaatcctatccagcagcaattcatcgatgatgctcagttgacgctcggcgagccgttaacgccagctgacaatccggcgattttaggcttgtatacgatgggcagtacctcatcgatcggtcaaagcacatcgagcgatctggatatttgggtctgtgtctctgctcaaatgagttgtgaggcgcgcgacaacctctccagtaaatgtctgctcattaccgattgggcgaaaagtcagggtgttgaagccaatttcttcatcatgaatgaagagcgttttcgccataaccattccgaagcgttaagcggtgaaaactgtggttcatcacagcacttattattattggatgagttttatcgctctgcggtgcgcttagcgggcaagcgactgctgtggcaaatcgtgccaccagaaatggaagagtgctacgacgaatatgttcacgagctctgttcaaatgggtatttgaactgcaatgaatggatcgattttggcaagttaaaccgcattccggctgaagagtactttggcgcgaacttgtggcaactgtataagagcattgactcgccttataaatcggtactgaaagccattttgcttgaagcctattcgtgggagtacccgcacactcaactgttgagtatcgacagcaaacgccgtttctttgccgatgaaccggatctgtacggcatggactcttactatcagatgttagagaaagtgacgcgctatttggtgcgaattggtgatagcacgcgccttgatttagtgcgccgctgtttctatctcaaaacccatgagaagttgtcgcgtgagccgggcgtcggctcgatgccttggcgtcgtgaagcgttacgggaactgaccagcgaatggcaatggagcgcagatttgattgccgagctcgataaccgtcgtcactggaaagtcgagcaagtgaaggtcgtgcaccacgcactgcttgatgccttgatgctcagctatcgtaacctgatccagtttgcgcgtcgtaatgacatcacctcggccattagcccacaagatatctcgattttggcgcgtaaactgtacgcggcgtttgaagtgctgccggggaaagtcacactgctcaacccacaaatttccccagacctgcatgagcccgatttaagttttattgaggtttgtgctggacgcaccaataagcccggttggtatctctacaagcagccgctgcaggcgcagcgcttgattggtcagccgtatcttgagcacaacgaatacttgagtaaattggtggcttgggccttttttaatggcctgatcactgagtcgactcgtttgcatgcggtggtgcgtgaagcgcagctggacatcgacaagttctaccaaatggtcagcgatctgcgtaataccttttcgctgcgtaagcgtcgccctactatgcaagcgctggccaatccttgtgagattagccagcttgccatgttcatcaattttgaacacgacccaaccagtgaattgagtgggaaagcgctgaaagtcgacctgaaaaatatcgatatttttagttttggtgctgagcagaaatgcttagtcggcagtgtcgatttggtgtatcgcaactcgtggcaagaagtgcgtaccctgcattttgaaggccagacggccatgcttgatgcgttgaaaaccgtgcttggaaaaatgcatcaggatgcgctgccgccagaatcggtggatgtgttctgctacagcaaaaacttgcgcggcgtgatgcgtaacttggtttatcaactgttggctgagtgtatcgatttgcgcctcaagccgatggagcaagagaaacgtcgtcgtttcaaagcgctgcgcatgggcgatcagatgtatggtttgttctttgaacgtcgtggtgtttcggttcagaagttggagaactcggttgatttctatcgcagcatctcaaccaataagctcaagggctcgcctttactgatgctcgatcgcgatcaagattacccattgccagcggtggtggatagttttgccagtgaaggtttggtgcagttcttctttgaagataccgagaaaggtttcaacatctatgtgcttgatgaggccaaccgcgttgaagtctatcaccagtttaatggcgaaaaagacgaaatgattgccagcgtcaacagcttctacacctcgatgttggatgacagcaataaactcggcgcgaaaagcatcaattttaacttgccgcagtattaccaaatcatccaccctgaagagggagaaacgtacgtggtgccgtaccgtaacgacagcgctgtgtattccaagccttcgcaagtggtcaatgcctaactcgttgacgtctcaggttttctaaatccttatcaataaaaaagagcacaatcgtgctcttttttattatgcgtcagtggcagcatgcctaagcgactttcgtgcttaaacccaatcaatcggctcatcggcgtgcttatcacactcttgcttgagcagagtgagcagctcaagcccagtttttgaacagatccattcgccatcaatcgatttgaaatggtagccacctgatttggaggccagccagatttcacgcatcggttcttggcggttaatgatgatttggctgccatcatcaaactcgagtgtcatcacattgcctgacgtttcgtagtcgatatccgcgccggcctcatcaatcgcggcctctatacgctctagctggctatcgacgagttgatgaaattcagtttcgttcatcctatctatcctattgcttttcctaatcgtggtgcgattatagggggcattgattcaataagcacgatatgcaaaatgaaaaagaaattcactgcactgtttttgttgtcggctctcgcgttagcgggatgcgggcaaactgggccactgtatatgcctgatgatgcaaaacaaagtgagcaaagtcagtaaatcacgctactaagaataaaagggaaagcattttggattacttcaattatcaggaagatggtcagttgtgggctgagcaagttccactcgccgatttggcaaaccagtacggtacaccgctttatgtttactcaagagcgacacttgagcgccattggcacgcgtttgataaatcagtcggtgattatcctcacctaatttgttatgcggtgaaagccaactctaacttaggggtattgaatactttagctcgtttgggttcaggttttgatatcgtctccgttggcgaattagagcgtgtattggccgccggtggtgacccaagcaaggtggtattctctggtgtgggtaaaaccgaagctgagatgaagcgcgccctgcaattgaagatcaaatgctttaacgtggaatcggagcctgagctgcagcgcctgaataaagtggctggcgagcttggtgttaaagcgccgatttcactgcgcatcaatcctgatgtggatgccaaaactcacccttacatttcaacgggtctacgtgataacaaatttggtatcacctttgaccgcgcagcgcaggtatatcgcttagcgcacagcttacccaacctcgatgtacatggtattgactgccatatcggctcacagctaaccgctctcgcaccgtttattgatgcgactgaccgtttactggcactgattgattcgctgaaagcggaaggcattcatatccgccacttggatgtcggcggtggtttaggggtggtttatcgtgatgaactgcctccgcagccttcggaatacgccaaagcattgctggaccgcctagagcgccaccgcgatttagagctgatttttgaaccgggacgcgcgattgcggctaacgcgggagtattggtgactaaggtggagtttctcaaacacactgagcacaaaaacttcgcgatcattgatgcggcgatgaacgatttgatccgcccggcgctataccaagcgtggcaagacatcattccactgcgtccgcgccaaggcgaagcccaaacttatgatttggttggcccggtgtgtgaaaccagtgatttcctagggaaagatcgcgacttagtgttgcaagagggggatttactggcggtgcgctcttctggtgcgtatgggtttaccatgtcgtcgaattacaatacccgtccgcgagtggctgaagtcatggttgatggcaataaaacctatttggtgcgtcagcgtgaagagcttagcagcttgtgggcgttagaatcggtattaccggagtaaagttatcttctatgcatttccatttttctaaaatgcacggtttgggcaacgactttatggtcgtggactgtattacccaaaacgtcttcttctctccggaattgatccgccgtctggcggatcgccatacgggagtcggctttgatcaattgttggtggttgaagcgccttacgatccagaatcggatttccattaccgcattttcaatgccgatggcagcgaagtggagcagtgtggcaatggcgcgcgctgttttgcccgttttgtacgcatgaaagggttaaccaacaagtacaccatccatgtcagtaccaagaaaggcaaaatggtactcaatgtggaagaggaagatctgatcaccgtgaacatgggtgtgccggagtttgagccgaacaagatcccatttcgcgccaaacagagcgaaaaaacctacattctgcgtgtcggtgaacacaccttgttttgcggcgcggtgagtatgggcaacccgcatgtagtgactgtggtggacgatatccgcactgctgcggtagaaaccttagggccgcttttggaatcgcacgagcgtttccctgagcgcgtcaacgccggttttatgcaggtcgtgagccgtgatgagatcaatttgcgcgtgtatgaacgtggtgcgggcgaaactcaagcttgtggcagtggcgcgtgcgccgcggttgcggtaggcattttgcaaggtttactggatgagcaagttcgtgtccatcttcccggtggtgagctggaaatccactggcaaggccccggcaaaccgctgtatatgacaggcccggctactcatatctacgatggccaaatctcttgctaattgaggttcaattttgtctcaggtaacggcggatgctctgactgcccaagtggtggcagagtatctttatgaacatcccgatttttttcagcatcatcctcatctggtcgaacgtttagccttaccgacccaaacgggcgcggtatcgctcgctcatgtgcagttagcgcgtcagcgccagcggatagactctctcgaagaggagatcaccgccttgatgtcgctcgcggcaaataacgatcgtactttccatgagtttatggatctgcaagagcagattctaaaatgctcgtcgctgcaagcggtgttacacgcgattgaagccaaagcgcgtgaactcaatctgcgtgcttacgtgcgcctgctgcagcgtcatgatgaaaaatacggtttagccagtgaggattggcagcgctttgcgaccaatcattttaatggcaaatcggcttatttaggtcgcttacgccaagcggatcggcaacgtctgctgggggataggcccgcgccagaaatgggttcgtatgtggtgttacctttgcagcgccaagcgccgttgggaattttggccttcgccagtgaagatggcggccactttcagccgagtatggataccttgtttttgcgccatctggcgttagtcttagctcatctgatcgagacattaccttggcagtcacacgatgaagaacgacgaacgcaccccgcttcctgatgcgttggctcaaccgctggagcgtttttacgcctacctgcatacggaaaaagggttgagcctgtatacccagcgcaattataagcagcagttggaaaccatgacccagtacttagtacaggttgggctcacccactggacacagcttgattcggcgtgggtgcgtcaattggtgatgcaggggaaaaggcaggggatgaaagccagcagtatcgcgacgcgtttgtcttcattgcgcagtttcctggattttctgattttacgtggcgagcttcaggctaaccctgcgaaaggcgtctctgcgccgcgcaagcagcgtactttaccgaaaaatctcgatgttgatgaaatggcgcagttactggaagtgaccgatgatgatccgctttcgattcgcgatcgggcgatcatggagctgatgtacggcgcgggtttacgtttggctgagctagtttcgattgatatcaaagacgttaatctaagcgaaggtgagatccgcgtcatcggtaaaggcaacaaagagcgcaaagtgtggtttgctggacaggcacaagagtgggtcggtaaatggctcaaattgcgcagtcaattggcggatagcgcagaaacggcgctgtttgtgtccaaactcggtacccgtatttcacaccgtagtgtgcaaaaacgcatggccgaatggggccaaaaacaggcggttgccagtcatatcagcccacataaattgcgccactcgtttgccacccatatgctggaatcgagcaataacctgcgtgcggtgcaggagctacttgggcacgagaacatcgcgacaacgcaaatctatacccacctcgattttcaacatctggctcaggtgtatgaccaagcgcatcctcgggcgcgcaaaaagaataaggatgactaaccatgctgttttaccgcccattggcttcgattcaagcactgacgtttgatttggacgataccctttacgataaccgtccggtcatcaaacaggtcgaggaaaaagtcactgagtggttgttaagtgagcatcccattacggcgacgcgtcctttggcttggtggctggcgatgaagcgtgatatagcgcgccgctttccggagcagtgccatgatgtgagccaatggcgttatttacaggtgcagcatggtttactggaattaggctatgcgcagccagaggcggagcaagcggcgagcgagacgcttgagcaagtgatgcgctggcgtaatcaagtcgatgttcctgccgaaacgcatcgggtgttggctcagttagcggctaaagtgccgctgattgcgatcaccaatggcaatgtccagatagaaaaaattggtttaagtggctatttccaaacggtattgcgcgcagggccagacggccgtgccaaaccgtatcccgatctctttgcacaagcagcacaacagcttcagcttgagccccgttcaatcttgcatgtcggggatcatttacaaaccgatgtgctaggggcgcggcaaaatggttttcaagcctgctggtttaacgatcaagggcagagtattcgtcggctcgccaaagcgagcgtattacccgacgtggagatcgagcgtctctcggaattacttctgatagttaactaggtgcataacatcgagtcacaaaaatcacattgcatggttattgagtatagtctgcggtaacgattgcattgcataatgcctaaacatttcactggcttatcagctctttatgtttacggtctcgcgtctcatcccagatttagcatcggccaatcaggtgctcgaaacgatggatcttcctcatgggcaatccatcttagtgcaaattttctctcctttgagtcgcgagcatgtcgtgcagcttgcgcggctcatccgtagtcgccatccacaagcttgcctgcttggatgcagtaccgaagaggtgattttccaaggggaagtgcaccatcaggtgacgttgctgcaaatcaccgtgtttgagcaaacttatcttagccgtgctgttgtggattacagtgacgatgaggctgccgacgcggagcgtttagctcgccagctcgagctcactagcatgtctcgagcagtggtctgtttttcttggcagatggataccttgcaagtcgcacgatttgccttacgcgacacgcagggtgcgccagtgcccgtcgctggtggagccgccaaacaaactcccagtggtcgctgggttttgctcgatgaggcttgttatcaaaacgccagtgtggctattgcgctgcatggcgaagcgctttatgtcgagacgggtggttacactgagtggcagcctgttgggcgcacctatcgggtcacagccgtggagggagatcgggtcttacgtttggatgatgagccgatagaggcgatttatcagcgcaatttgggcgcgcaagccgacttaccccatgactggctgatcagttttccactgatgaaaggggaatgccgccaccaagatctttatctgccgctcgggctggcggaggaaggcggactgaggtttaaccgcccactggcgctgcaagatgaagtgcgcttttgttttgatcacccgagtttaaccctagagcgggtctatctcaccgcgcagcaactacaagccaagcagtgccaacaagtgtgggtgtttaactgtgcgctgcgtttaaacttcatgcatgagaatcacgagttacaaccgcttcaggcggtggcgccgaccgatggttgttactgttggggagagctgctgtatgagcatggtcagcagcaagtgatgcatcatagcatgacgtttcttgccttgcgtgaaggggcggtgcgtgacgatcttgtcccaatccccttgccgagttatccggaagggatgacgtcccctctgtttaatttgatccgccatgcgtttcatgatttggatgccatgacggacaatttggcacagcagatccgcgctcaaacctcattactgacggcgagttaccggcgtgaccgacgtaccggcttacccaatcgagtggtgttacgtgagcgattggcgaacttcgcggccaatgagcacctaatcgccctgaaagtgaccaacttcaatcagatcaatgagaagtacggttatccggtaggcgataagctgcttcgtgatttgagtgaacagtttcaggtctttttggatcagaaattggcagggcagagcggtttgtatgcgattggggtcggtgagtgggcaacggtttttcgtgccaagctggacgggaaaagtattcatagccatttctatcagtttgtggagcagttggagcacgtcaacttcgagccctacggtttaccgaatgtggattatctgtcgatctcgttgtgcgctgggttagtcagtcagggcgattttgcagagcattcgccggatgagctattgctgcgtgctatcgaagcacgccgctacgcgtttaacaacaaccaccatttctgtaatgcagcgcgtttaaaagtgcaagaaagtgttcgtcaggagcggctgaattggctatcgcgggttagccgcgcggtggtacgtgatgatgtggtggtttatgcgcagccgatttgtcaggcgcgtagtcacattgtggcttcctacgaatgtttagtgcggattgaagatgaaggggaaattatcttgcctgggaattttctcccgatcatcaccgatactcacctctatactcgtttgagccggcagatgataacgcataccttcaatatgatgcgtcatcgcccggaggcgttttcgatcaatctttcaccgcaagatttgatgagtgagcgcaccttgcagcatttggaagcggcaatcaaatcggtggccgatcccgcccgtgtcgggctcgaagtgttggagagcgaacaaatcaaagattacgggcggatgattgaagtgtgtaaccatttccgcacactgggcgcgaccatcattgtcgatgattttggcagtggttattccaatattgatgagatagtgaagcttgagccgcaggtgattaagctcgatggcagcttgatccgcaatattgatcaggatgtgaagcagcgccggattgccgagcagctcgtgaaattgtgtcaggtactgaatgcgaaaaccgtggcggagtttgtccataaccagacggtttgtcgcatcagtgaagatatgggtgtggattatttacaaggctatttcttgggtcgaccttcacgcttgggttaacgcaagatagacgcgtcatcccatcttgatatttaccgttcaatccaacgatgaccgcttttgtcggctttaaaagcgttcatcgaatagtgataaaactgctccaaggcctcagctgaagcctcggcgttgaaatggcgcagtagcattaatcccacctcaagggtgcagagattgcccggctgttgattgcgcctgagccgatacgccgacacgtgatcggtggtaaggtgaactctcggaacatcggctagccaagggcttttacgctccattttgcgcgcttcctgccaagtggcatcgagcacaataaaatgcgcgatctcatcttcgcgcagcgagcggagtgcatcggttaattccacgctctcttcggatgggtaaaccagaaacgagcgagcgttgggttgggtgaggcgcgcttgtaactcagtattagccgcgactcggctccatgtataggcttggcactcggccatggatttcaccagccagcgcccagtattggtttcgcgctgccactcattatcgtgagtgagcagcgagagttgaaacggcgcgtggaagctagggacggcggagcagaggcattgaaatttaagcccgcagtccggacacgccgcattcatagtttaatgcctgactgtcttggcgagaggccatcggcaaacagtaccacttggctgatttgctcggcgttggcttctggtgccacacttgggttcgtcgggtagctgatgccgttgtattgtaaacggtgtatagcgggtttcgcgccgccgccactgacactgaacagtaagtcttgccagccatgatgggtctgtttacctaaacggatcgggttttgtacgagagtgatgcggctattgaaacgccactgctgattgtgttgatcgaaaatcagcaaagtacagccgccagtaccacaccagtctagttgcaccagcagttccggttgttcatcaccgttgagatcgtacttcaaccagcgatattgcgtattgtctggcgacgtttggtgcaagttaaaatagcggcgaatcgcctgatcgacatcttcttcatagtcagcgcgtcctgcgatttgctgagcgtgaatggccgcttgtcctacggcagggggcacagcgctttcattcaactcgaccagagagcgaaacagcactaaacctccatcggcgatgttataaaccgattgaccaaccttctcttgtgtcgctgttagctgataaccctcacgagtgaaaatgcgctcggagagcaagtactgctgctggtggcgagtcatcaccacttggatctgattggggttgagctgctgccagtagccttgctccacgacagccggttcgccattggcatactcatagcgagtctgcgcggtgtgatctttttccaaggttaagctgacactaaagcccgtctgttcagtcgagctggcaaagtagacgccgctccattcaagggtaggatcaagattagctaaggtcgcacagccttggtattggccgccttttagggtgagtttagagcgccattggtaaaggttatcgctcataccatcgcgacattgcccttgttctaacagcagttcaccaccatcaaattggtagcgtcgtttatcttggctcagttgactgcgtgtgatcgaaaattgttgcttgtcaccgcccataggttggaattgtagcccgccatctacaaagcgcattgaccaaaaaggctcattaccaaacgcacgggttgggctaagaggctgctcacagccgcggctttcattgctcagttgattgatgctctgcacctcaattcgcgccacataatcaccgttaaaccccgtttggcttggtggcgtgagtgtgccgacaagctcaccatacagaggttggtaaggactacgattcagcgccatcgcttcattcagttgctctggcgagagattgagccagtattgctgatggctgccacagggcgtaaagcgtcgcacctcatggcccacgaccacctcgccacgcagcataaagctctgtggttgaatggtttccggtttatcgagggtcgctggaataattggagcggagtcaggctcgacactgacggaggtggtgttggtgcacgcttgcaacagcatagcgagcgacatggcgcagaagggcaaggctctcattgatcaattcctttggctcgagatggaataggggatgtttggtcgcaaaaattatcgcacaaactgaaagacaagctaaaccgtcacagggttcaattgacagagtgcaaacaaaggaacgtattgtttgagagcggtttcgccattttgcgcggtgagtggctaaggaacggtgcagaaaatagccaacggcagcgttaggctgccgttgagtgatgctcaggtgatgcgcttttacggcttaacctgagcgcaataggcaccgagtgagacgtgaatcgggttaaaacagatgctgatgcaggtaatgcgccaccgcatcatcggcgttactgccgatcacttcattatccggcagggcgttaaacactttttcatgggcggtgcccataactaagccttttccggccattgagagcatttcgacatcattcatgccgtccccaaacgcgatacagttttcaaggccaaggtgaagagattcggccacagcttgcagcgcatcgccttttgatacgcccgcacacatgacttctaggcaccaaggtgttgaaaaagcaacgttgagtttatcgccaaagcgctgattcagtaaggtttcgtactgcaccaaatgttcatgatcttggtcttcttgagtgaagaaaattttcgcgatgccatcggttggggcgttattgacatcaaagacgcgataggtaaaaccagagtcttcatggaagtcgcgcaggatctcatcttctttattgagcatccattcgtcattacggtacagatgcacgaacaactgcttatcgtgtttaacgacatcgatgatggcttgcaccaaatcttgcggtacgtttttgctgtacatcagttggtcattctggtcatgcactcgcgcaccgtttgaggtgatcatatacgcaggaatccccgcgatttcacgaatccccgcgacatcaatgtggtgacggcctgtcgcgaaaataaaggtaaatcctttatcgtgcagctgtttcaaagtctgtttcgaaaattcgctcaactgatggttcggggcgagtaaggtgccgtcgagatccgacgccacgattttatacggatgtttgtgtgctgaagtggtcataaaactctctgtttctcggttggccggatgagccgtcacccttaggttgcctagtgtagtggaattaaatgcggaaaaagagggtaaacctctctttgcgcttttcctcaatttctatggtcgatggtgctgtcttttatggtcgatagtactgtcggcgaaaaaacgcaaaatatggtctaacgtctgatttcggtaggcatcttgttcaaaaagcagttcatgtctggctcctgctatgcggcataaagcggcacgtttttgggtgcgagacagctttttgaagagccggatttgcgcccgattacacacaatcgcttcttcgccagcttgtaagatcagcatggggattttgatttgtcgggttaactgcaaacactgtttggtcgccattaagctctgccaaacccagcggtgactcggccctccaatttgcagttcagggtgcgcttcatacagttcacgaaacaactgatagcgggtttcactgtgggtgagcaggttgagatgaaagggtttagcgtgataagggccataacccggagcgtaactgggttttagggtaacggcagccataatttgagtgatgagcaaagcccatggccttaaataccaaggcatattcacgccaaacatcggagcactcagggccagtgcgctaaaggggtgcgctggagtggtctggatatagcgcgtagcaatcgcgccacccatagaatgggctaataaaaagcgctcttggtagtgaccgagatcgaaatgctcgactaaggcttttaagtcagtcacgtaatcttgaaactcatgtacatggcctatttgtctatcttcagtcagacgttctgaccgtccttgaccacggtgatcataggtataaacatcaaaaccttggcggaataggtcataacacagctcttgatatttccacgcagattcaatcctgccattcacaatcactacggctttttgatgctcaggatgcttgagactacaccaataaatgtgcgttttatcaaaactgcgataggttccttcgcttcgagtgtgccacacttgagctatctcaaagttgagagcttgctccaaactcgactcttgcgtataaggataaagatttttttcagggttcataagttggcaatggggttgtgcgaatcagtgtttgacctcattgggctagcataagtcaggaatgaggaattgcaatggatatccatgtttggcttgcctatctactgaccgcggtggtgtttagtctggcgcccggttcaggcacggttaactcgatcagcaatggtttaagttatggtacacgccactcattaggggcgattatcggcctacaaatcggtcttgcttgtcatatagtgttggtcggcattggaattggcgctttggtggcacaatctgcgttggcgttcactctgatcaaatggattggcgcggcttatttagtatggctgggtattcagaaatggcgagatagagcccccctaacggctaccacaacttctcatgaactctcacaagccgccctgctgcgtaaagcagtactgattaacctgaccaatcccaaatcaatcgttttcttagtggcattatttccgcagtttattgatcccactagagatcattggccgcagttcttggttctgggtatcacaaccgttactattgatgcgattgtcatgttcggatacacggcactggctgcgcagctaggtcgctatattcgttcacctaacataatgaccagaatgaataaactgtttggttcgatgtttatgggctgcggaatgctgttggctaccgccaaagcgtaagcaaccctttgaggacaccatgtacacaacttatgtagcacgccaaccgatattgaatgcaaagcgacacacgctaggttatgagctgctgtttcgagatggagaaaaaaacgcgtttcctgagtacatggatgccgatcgtgctacctaccgtctgattgttgaaaactttttatcccttggtaccaacccgagaattgcccgctcgcgctgttttatcaactttccccataaaagcttaattcgacgtttgccgctgactctgccgcgtgagcagatcgtggtagaaattttggaaacgtgccaaccgaccgatgatctttttgaggcggtacaagagctgagtcagcgaggttatctgctcgcgttagatgattttgtgtattcacccgcttgggagcgctttttaccctacgtacagatagtcaaaatcgacatcatggcaatggggctcgataaagcgtgtgaatttgtgcgtggtcgactggctcagggaagtcgtcgccgatttttggcagaacgagtcgaaaccgaagatgagtttcatcaagcgcgtcatgcgggttttaccttcttccaaggctattttttcagtaagccagaaatcattaaacagcgctacgtcagtccagagcatgtgattgccatgcagctgtttcgcgaagtctgtcagcctgaagtcgattatgtgcgagtagagcgcttggtcgcgcaggacattgcgctctcctacaagctgctgcgtttcgtaaacactatgtcggatcggatctcggtctccatctcctcatttcgccaagccttggtttatcttggacaggacaaactgcgcattttcgtctctttggcggtcgcgtcttatatctcctccaaaaagcccaaggagctttacaacttgtcgttacaaagagcgcagttttgccagttgatggcgacgcatacacattttaaagcgcatcgtgaacaagcgtttctgattggcatgttttctgtgctggatgccttgctcgatacctcaattgagcaattggtggagcaactgccgctggccgatgatgtgaagttagcactgcgagagcgtgaagggccactgggtactttgctcgatcttgaggaatgttttgaaaaagccgattggcaaggtgtggagcagcactgcctagaactgggttttgatctggaagatgtccgtcaggaattgattgaagcccagcgttggagccaggacatcaatcgattaatttagtgataagttaatgcaccttttcaacttgacgcggcagcgatgttggcagcaacggcaagtcatttggggagagatggtcggccagcccgactctgagggtgtaggatgataaaggctgaccgaccaaatagattaaccttcctgcaccttagatttagtgagcgtgtcagagcggtgagttatttcagccaagcgttaagcatccacaccaatttctcttgctcgcggatgtaatcactcatcagcgctgacgtcccttcatccccggtttcgccggcaagctcaagaatgtctcgttgttggtggagcagaatgctaaaaccatccaccaatccctgcatgctgctacggccatcaattgagtcggtatgctctttgatttgcgccgctttgaggtaaccgctaaagctgtgcatgggtcgagcgctcagcgttaaaatacgctctgccagttcatcgatttttagctgtaagtcggtataaatctcttcaaacttagcgtgcagttcgaaaaactccttaccttgaatattccagtggtaaccgcgagtattcatatagaacacttgatagttggccagcaagttgttgagcgcattcgccagtttttgactttgtgtggtatcaagaccaatcaaattcgttgccatttttacacctctcagttttttatttcccctatcgggatgaacaaagaatagtgtagttcagatatggaagaaatttggattatctgatttttctgataggcatagactattaatccattataaagagtatggtttaatcgtcttaatggctgttctcaagaaccagattttaacgcttcaaggcaaagtgcaaaaagcgttgtccttggtaagttagtacgcctttgtctcctggattgagtgcatgatagtaatgaatgccaacctgaaactcgcgttttggccctaaacgtcctttttgtacgtaaatccaaaactcttggtcatcttggccgggaagagggtgaggaatgtcgatcgcttgcttatccagtatggtcacttcggcactacgctgtggagcattttctccttgcatgtggcggcggtagaagtggctaaaaaaccaaactgccgcaataatcaataacgctaaactgatcaataaagtgaagggcataacagcctcctattctgaatacgccgctattttagcgaatgacgtatttttccaagcagtttgtggtgagaaagagatgtgcggcagtaatcaaagggattttttcggcttatctcacactttatcagccattgaacggctaacaattggataatgtgactctggctgctagaaaataaagagagaaggcgcaggagggcggaaatgtcagaaattgagcaagttgttctacgaacgcgcaaactcgaaaccttattgcgcgaacaataccatgcagaaggcaagggattgcatcaattgattaccagttgtgaagaacgtttaccccatgacgtgattaaaaagctgcgttatgtggcgacgattcgtaacaaagtggtgcatgaagatgattatcgcttagatgatcgcaaagcttttctcgcggtatgccaagagtgcgaagatgagctcacgccaagaagtgggaagtttgtgtggcggattgcttttatgctgatgatgttgatgaccttaggagccctatttttctattactggcattgggaagagttatctcaacattttcagtaatcgaacattgaaccaataaaaaaggacgcgatgcgtccttttttattttaaaaacattaacttagtacatcatgggcagtgtcattaaaccaatgattactgcgatcataacaagtccttgtttttgagatgaagaaatcataacactgctcctttggttgattactcattctgtaaaaaaagaatagatcatttacccagcttgatcaatagatcgttgattaaagtttaaaaaacacagttcttttgctcgtagggggctttttaacgtaagaaaagtcacacttttacgctgttttaatcataagctaaatgctgatttttaattcaatattgtatttattttattgattttatagtgttttttattgtttgttggtaggttgttatttgttctggttgtggttattacggtttgttttggatcgattgtcaggttttagtaaattaccactttatgagaattatttccatgttgttgagattggttatcaattgagttgtgtttttatcctttatctgtttttatatctttaaaaatggcagttatttttcatttatctgtttagttggttgttttcaattttttgatttttttgttgttgtttttattggtttttgtttttattttgcagttttggtttggtggatttttcgtttttttattttgttttgattgtgtttcatttgtttggtgttgatttgttgtcttggtttggttggtggcaagttttcttgttttgtaattttattgagtaattactattttatatagcagctcaagtaaggattcgctagcaagatccaactttttactttcataactggacatcaaaagtcagatccctacactggcggcagtttgagttaggggtatgagcatgttgagctggatttctgtcgtgttgtcggggtttatcagcatttctgcttatgaaaatcagaagcttaagcaagcgatattctttcgaatcttcagcctcctgttactgacaattattgtgtgggagcagcacagtcatgccacgccagaggtgatttttatctctcttggtttggcggtgtcgatgtttgcgcatggactgcggctaaatcatcgctaccacaaagccagctttgtgctgtttttagtcgcgcaactgctgtttagtaaagcattctgggtgcaattgtcggggagtatggtgtggtggttgcccgcattactggtggcggcaagcatagtggcgttttttttgttactgccacaaattgataccttaatcttcccggtcaccattatggggttgatgttagtacagatgacgtgggctgcgggtgaactgtggctacaagaggccaccgtggcttctggcgctggtttcttaggatgtctggtttatatcctctcggccacgttattagccatccacgattatcggcgtccacttccttgggggcacactcttatctccagctcctacttgatagcccaagccttgatctcagcgtcgatcgtgttttagtcatattcacggtctatgatgtaaaaaaaccgcctcgcggcggtttttttacatcatgtatttacggcgaatatccaacagggcaaaaatgccaaagatcagaattgaccacttttcccagcgcttcagtggtactttatcgccaaacgcgccaatgaaaatcaacatctgtaaaccatgcatgaagagcaaaaatgcggtcatgatgtagagtgcgatggcggcattacccggaaaaggcatcacgatgttgaacagcaaaaccagccatacaaaaccaatcgccgctttcgctaaccagagtagtgctttcattgttcttcccttataaacagccgataacagacttgtccggcactcttttctcgatgtagatgccaatgaggaggcaactccgtcagtggcagctctttttcgcactcaatataaatcatcgcttgtggcgcgagccaaccgttttgctcgagtaactgagtggtttcctgtaataaaccttgtcgaaaaggtgggtcaataaacaccacgtcataaggtttacccgattgtcgcagaaaggcgagtgcatccgtgtgaataagctcaatattttctgctttcaggctctgtacattagttttgagttgctgaaaggcgagcgggttcagctcaagcatggttacttggttggcttggcgtgatgcacactcgaagcctagcccgccagaaccggcaaaaagatcgagacagcgagcatttggcacttcttgagcaagccagttaaacagcgtttctttcactcgatcggtcgtcgggcgcagtccttcggcatcatgcacgggcaattttcggccgcgccacagaccgctgataatccgaacttgccctgtaggggcctttttttgtgatgggtttggctggcgacgtctttgcatagattttttgaccgctaattaagtgttactatacctcgcttgtcagccatttggcgtgacaacccgagttaacataaaaaactgggcaaagtgtaccaagcgaagcaaaaagttttcactgctttgtcattttttcttttcggggccgcaataatggccaagaaaagtctgtattaaaataaagcgattcaggatagctccagatgacggaaaaaaagaagcgtggcttgttgtcatggcttggatttggtgacgaagagaaaagccaaaccactgcaacggatactcaaacgcaggatgaaccacaaagccaagccgatgttgaagcggtggcgattcaaacggaaactgcgttaacagaaacagaaacagaaacagaaacagaaacagaaacagaaacagaaacagaaacagccacggttgaacctgcacgtattgttgaacaagagaaaccgaccgaaagcttctttgcgcgcttaaagcgcagtttgagccgcaccaaagcgaatattggcgctggcttctttggcctgtttaaaggcaaaaagattgatgatgacctgttcgaagagctcgaagaacaactgctgattgccgatgtcggcatggatacgaccagcaaaatcatcgctaatttgaccgccagagcttctcgccagcaactgcgtgatggggaagcgctgtacggtctgctgaaagaagagatggccgagattctctctcaggtcgagcagccattggtgatcgacactgagaaaaaaccttacgtgatcttgatggtgggcgtgaatggggtgggtaaaactaccacgatcggtaaactggctaaacagttccaagcgcaaggcaagaaagtgatgttggcagcgggcgataccttccgtgctgcagcggttgagcagttgcaagtgtggggagagcgcaatcaagtgcctgtcatcgctcagcatactggcgccgacagtgcctccgtcatttatgatgcgattgaagcggcgaaagcgcgcgggattgacgtggtgattgcggataccgcaggccgtctgcaaaacaaaagtaacctgatggaagagctgcgcaagattgtgcgcgtgatgaagaagattgatgacagtgcgccacatgaaatcatgttgacgctggatgcgggtaccggacaaaacgcgatcagtcaggccaaattgtttagtgatgtagcgcccatcacgggcattaccttaactaagcttgatggcaccgctaaaggtggcgtgattttcgcgattgccgatcaattccagatcccaatccgttatatcggtgtcggcgagaaaattgacgacttacgtccatttgcaacacaagagtttatcgacgcgctatttagccgcgaagaataaaccaatctcagttggcacagtgtgccagccttgtcagggggagacggcgtgatcaggtttcagcaagtcagtaaagcgtatcgaggtggacgacaagcgctacagaaagtggatttccacttgcggcgtggtgaaatggcctttttgggcggccattctggggcagggaaaagtaccctacttaagctgatttgtgcgattgagcgtccaaccgatggcaaaatcagtttcaatggtcatgatattactcggatcccaaacaaggatattccctttttacgccgcaatattgggattgtgtttcaagaccatcgccttttgatggatcgcagcatctatgacaatgtcgcgttaccgatgcgcattgaatcgatctcggaaaatgaaattaaacgtcgtgtttcggcggcgctcgataaaaccggattgctcgataaagcccgctgcttaccaagccagctctctggtggggaacagcagcgagtcgggattgctcgcgcggtggtgaaccgcccaacgctactgctggctgatgagccgacaggcaaccttgatcctgagctttccagccgagtactgcgtctgtttgaagagttcaatcgcgctggggtcacaatactgctggcgacgcacgatattcatttggtgaattcgcgtccgcaatatcgtcatctagaactcaatcagggttttttaagtgaggtagcggattatggccgttaagccgggcaatcaaaaaatcagcaaaaccaccaaaagtaccaaaagcaaaccgcgtgatgtgaagcgagccaaaaccgacagttttctcgccattcatttcaaacaggcgaaagcatcgtttgccgccttgtggcgacgtccactgggcaacattttgactttggcggtaatttctatggcgttggcgctacccgccagtttgtacttgctgagtaaaaatatcgcctcggtggctgagcgagtggctgagccttctcagctcagtgtttatctgcacatcgatacaccagaacctcggatcatcgttttgaaagatgatttggagcggcgtgatgaaattgccaaagtgaaatacatctcaccgcagcaaggtttggatgatttaagccagtatgctggctttgagcaagcgatcagcctactcgataacgccaccttgcccgcggtattagtggtgacgcctaaagtggacagtcgagagcagatccaaacgcttgccaaagccctacaagcagaagagggggtgaccgatgtgcgcatggatgaagattggtttgcccgtttagatgcgattcgccatttggcgactatcgtggtgattagcttatccagcttgatgttgatgtcggtttttttgattgtgggcaatacgctacgttttaacgtacaagccaacaaagaagaaatccaaaccatgaaactcatcggtgcgaccgatgcgtatattctgcgtccttacctctattcagggatgtggtttggtttactcggcgccgtggcagcctggctattaacggccttgatgacgattttactcaatggtgcggtggaagcgctcgctcaattgtatgacagccgtttccgtttgattggcctcggctgggatgaatcattactgcttttaatgctcggcgtctttttaggctgcgtggcggcgaaagtgtcggcgaaacgccatctaaaagaaattgaacctgtttaagtgatggtggtcataaatgggtggctgattcaaggttgaggcagtgcttgacttgagttgcccttttgtttatgcataatgacaagtcaaacttgaaacctgttcattttaggttcaagcttgttgcggtaaaacagcgtatccagatcagagaatgatgaggaattgaatgactaaccaagcgtatccaatggctcttgtttcccaagacagcttagatagctacatccgttcagtaaacggttacccgatgctgagtgctgatgaagagcgcgagctggcagagcgattacattacaaaggggatatcgatgctgcgaaaggcttgatcttgtcgcacctacgatttgttgttcacgttgctcgtggttattccggttatggcttgccaatggcggacttagtgcaagagggcaatatcggtctgatgaaagcggttaaacgctttaaccctgagatgggggtaagactggtgtcgtttgcggtgcactggattaaagccgaaattcatgaatatgtgctacgtaactggcgtattgtgaaaatcgccaccaccaaagcacagcgcaaactgttctttaatctgcgtaaatcgaaaaaacgccttggctggtttaataacggcgaagtcgaaacggtagcgcgcgagctgggtgttgagcctgctgaagtgcgtgaaatggaatctcgtctggcagcccaagatgctgcgtttgagatgtccgccgaggatgacgaaaacggcatggcctacactgcgcctgtgctgtacctcgaagataagcactctgacttagctgataacctagaagccgaaaactgggaagcgcataccacacagcgcctcagcatggcgctggcaagtcttgatgagcgtagccaacacattgtgcgtgctcgttggttggatgatgacaacaaaaccacactgcaagatttggcggaaatgtatggtgtttctgcggagcgtattcgtcagcttgagaaaaacgccatgcgtaagctgaaagaagcggtgggcgagttctgatttcacattgcgtaacagcttgataagaaaaggtctggtcaatgccagaccttttttgtctctatctatatacccttcctacttgaagctgcagcggtgttggctacgttcgttcaccccaatcacatagtgtatctatgcacatggggatgaactcacttgccgtctacctgcaactctaagtagtttgactctagcgtattaaaacagtcgattaagaccatttaaggctgcaacacggaaggcttcggccatcgtcgggtagttaaaggtggtgttcacgaaatactcaatggtattggcttcccctttttgttccatgatcgcttggccgatatgaatgatttctgcggcacgctcaccaaagcagtgaatacctaaaatctctttggtttcgcgatggaacaggatttttaagctgccgatatctttgcccgcaatttgcgcgcgcgccaaatgtttgaaagaagcgcgtcccacttcataaggcactttagccgccgtcagctcttgctcggtacgacccacggagctgatctcagggatggtatagataccggttgggatatcttcagtcaacaaatgtgccgcttggccatgaatgatggcttgcgcgacaaaccgaccttggtcataagcggcgctggcaaggcttgggtaaccaatgacatcacccaccgcataaatgtgttccacttgagtctggtaattggcgttgacgactaactggcctcgcgaatcggcttgtaagccaaccgactctaaattgagcttatcagtattaccagtgcgcccgttggcgtacaacaagcaatcggcgcgcatttttttgcccgatttcagatggacgatcaccccatcgctggtgccttccaccttgtcgtaagtttcatcattgcggatcaccacaccactgttccaaaagtggtaagagagcgcatcagagacttcattatccagaaacgacagtaagcgatcacgggtgttgatcagatccgttttgacatccaagccgcggaagatagaggcgtattcacaaccaatcaccccagcaccgtaaataatgatatggcgaggatcatgttcgaggttcagaatcgagtcgctgtcataaatacgcgggtgaccaaaatcgacatctttcggatgataagggcgtgaaccggtggcgataacaaatttatcggcactgtaggtgtcgatgctgccatcggcttttttgactgctacggtgtgagcatcaataaagtgcgcagcgccaaaaatcagcgtgcattgattgcgatcgtaaaagccttggcgcaggcgtgtttgtttatcaatcacgcttttggcgtgacttaaaatggtcgaaaacgtagcgtgaatgctggagttgtttttgcaaaacagcgggttgctattgaactcaataatgcggcttaccgcgtgacgtagggctttcgatgggatggtgccccaatgagtacaacctccgcctacactgctctctttttctatgatagcgacattttttccccctttggtcagccccatggctgccccttctccgcccggaccgctaccgatcacaatgacgtcaaagtggtttttctgtcccatagtgaatccttgttatatttgcttaacattgctgttgcgagattttaacgcattccctgacctggaaacatgctgcaaggtgcagagagtggaggggatcacgccttcattgcaaaacaggtactcaaccttgcttgattccaatcgcttttgattacattgagttagcatcagcaccattattatctggtatccggttgcgaaaatggctgctgtctcatactgacgagctttgttgcttagacaagccaaccaatcaggttatagtatgaaccacatttttcgacttagctgagaactgattggaatgaaatcgttgggaatccgagcacaacaaaaagaaaagacgcgccgctctttaattgatgccgcgtttagccaactgagcgctgaccgaagtttctctaacctgagtctacgtgaagtcgcccgagaagcgggcattgcgccgacctcgttttatcgtcacttcaaagacatggatgaactgggtttaaccatggtggatgaaggtggtctgttattgcgtcagttgatgcgtcaagctcgccagcgcatcgtcaaggaaggcagtgtgatccgcacttcagtggaaacctttatggagttcattgagagcagccctaacgtatttcgtttgttgttgcgagaacgttctggcacttcctgcgagtttcgagcggcggtagtgcgtgaaattcaacactttgcggctgagctcaccgaatatctggttgccacagggatgacgcgggaagaggcgatgactcaagcagaagcttccgtcaccttggtctttagttcaggcgcagaagcgctcgatttggatcgccgtgaacgcgatgaactggccgagcgtttgatcatgcaactgcgcatgctggccaaaggggcacattggtatcgtaaagagcgtgaacgtcatcgcctgaaaggcgcgttggaataagtgcaatatccaaaataaaagaggaaaaaggaaagagagatgtcgagagaaaacaacgttcagtccactcgcgcagagcgtaaaacattaatactggcgctggtcgcgggaatgtgcagtgatgctttgctttcatggctcaccatgagttcagtgccattttctctgtttgctttgatagctttagtactctcagctcagatgctttatcaagagtatttggctcatccggtggcggaagaggtgccattagtcggtctcgcctgtttcttcgtcggggcttttggtcactcggcttttatcaaagcacaatacccgcaagaagggtcgaactttttctccatcgtcatagtactgctcctgatcttttggattgggcgtaagctcggttacatcggtaagccacgctaaacaaaaaacgagccatctggctcgttttttatgcggttactttttgcgctctaacatcacgcccgcttccatgtggtgggtgtaaggaaattggtcgaagagagcaaagcgcaccacttgatgggtttcccccaagacttgtaagttctcttgcagcgtttctgggttacaagagatgtacagaatgcgctcataaccttgcaccattttacaagtgtcgatatccatgcctgagcgtggtgggtcgacaaaaatagtgttgcaacggtagctttgcagatcgactcccgcatccttcaaacgattgaattcgcgtttaccttccatcgcctgagtaaactcttctgctgacatgcgaatgatctgcacgttgccgatctggttcgcggcaatattaaattgcgcggcttctacagaaggtttggctaattcggttgccagtacacgctcaaagttttgcgctaacgcgagtgagaagttgccgttaccgcaatacagttcaagcaaatcccccttgctctcttgagtacaatcgaccgcccactccaacattttttcggcgaccttcgcattaggttgggtaaaactgttttcgacttgcttatatacataaggctggccattgacctgtaaattctccaccacgtaatcacgatccagcactactttcattttgcgagcacggccgattaagttcaggttgaacccttcatcgtttaggcgctgtttgagtgcttgcgccacagtgatccattcttcgctgagctgtcgatggtacagcagtgaaaccaaaatctcgccactgagggttgagaggaaatcaacctgaaacagtttatggcgcagaatagggctgcctttcatcgcatccatcagcagaggcatcaaatcgttaatcaggcggctcgccgctggaaattgatccacgcggtacttttcgcgcgtctcttgattaaacatgatgtagtacatgtcatcgccttcatgccaaatccgaaattcagcacgcatacgataattcgccactggcgactcaaacacttccagctcaggcatggagtaatcaacaaacatcgcttttaaacgggcgattttgtctgccaattgagcttggtagagttcagggtttacatcaagagtcgccattcgggtacctttttatgggctattacagaaagagcgcagattttattcaatctcggccgcttgtccagttttgcccaaatattgattgggatattcagtgtaaagcctagcggatcggaatctgtactggacaatttttcattcactcaatactatcagcgccaagctggtgctatttagatgcctggatggctaaaaatggctgaaaagggaatccggtgtaactccggaactgacgcgcagcggtaagagagaacgaacgctcaaacgacactgcttttcgagtgggaagtcgagccagtaggccaacagtgctctcaagtccgaagacctgccagcaactgagttatgcagtggtattgcactcggtaggattcacgcgatttaggacaacataatgcaaaaatcagcactggcgatcgctctagcatcgctgcttacccctatctcttatttacacgccaacgaagcacaacctcaagaaacggttgttgtgacggcaaatcgttttgagcaaaaggccagttcaactttggcggatgtggaaatcattacccgccaagatatcgaacaaactcaagctaagacattgcctgagttgttacgtagattaacgggtgttcagatcacgcaaaatggtggacgtggtcagttagcctctttattcgtacgtggaacaagttcagatcaagtattggtattagtggatggaattcgttttgctcgtgctgcaaaaggagcggtcgatttcaaccaaattccactaacttatgttgaccgtattgagtatgtgcgtggcgctcgagcttcgttatatggatctgaagcgattggtggtgtcattaacatcattactaaagctcgttcacaacaacaaggcacaaccgtaagtgctggactgggttcattggattaccaagaactcagtattgcttctggggttgcgattggtgaaaaaggccagatgaatgtggctttgggcacagagagtgataaagggtacaacgttcgtccagttcctggagtgaatgatggtgatcgtcacggtttcaggtcagataatgcgttgttgggttacgtgcaccaatttgatgagtcttggtctttgtttgccaatgcccgcgcttatgaaaatatttatcagtacgacaacagctatggtactcgtgactataaagaggcagaaaaggatgacctttcttttacaattggtactcagtatcaaagtgaacgttgggtatctgaattgcagctaactacccagaagcaaaaatcatgggattacacccagtctaagggaaaatactcggacacatcggataatcttgaacaacgaaatatccagtggattaatcgctatttggtcaatgatgtgtggacgttcgctggtggtgtggactggcgagacgagtcgtatattgataaaacagcggataaagagtttgaccgcagcaacactgctgcatttgctgtggttgctgctgagtggcaacaatggctgttggaggcaagtctacgctttgatgataaccaagagtatggttcgcaaactacccacaacattgctctagggtatcagtttatccctgagttcggggttaaagcatcttatggctcagcatttaaggctcccaatttatatcaacagtacgatccgtcttatggcaatgttaatttacaaccggaagacgcagattcagcagagttgagcttctacggcttattttcaggtattaaatggtctatcactggctatgattacaaaatcaataacctgatcgattacaactcaacaacgaagaattaccaaaacgtaataggtgagagcaatataaaaggagttgagtttacagccgagtttgccactggaattgtgcagcaccagttaagtgttgacctcaaagatgccgatgatagtaaagggaaaacattacagcgtcgtgctgagcatatgtataagtggaatgcgctagtggctttcgaacaagtggattggtcaattggttaccaatatgtaggtaaacgcccagatttggactacaacacttaccccactcaaaacataacacttgatgcgtattctctcgttgatacctcagttagctactatgtcacagactcgacgactattagcgctcgaattgataacttattagataaagagtacgaaaccgccaatggctaccctgctgctgagcgcgcgtattatcttaatattggttatcagttttaaacttagacactgtctttaatcacaaaagccagtcagaacatctgactggcttttattgtttaatgcgtcatgttagtagcgagccaccaaactgacattgttaaactcagtggtgccatagagtgtaatgaagtggcgaccttctcgggtattcgggaaggtacaaacttcattattgccgttgcgataagatgcgcaatcccaagcaaacggttctggctcaatacctagacgaacatagagatcaagattacccgtacctccgttggtctcgatactcaagcgacgacctgcaggcacatcaatatagaattttttcaattcaccttgcttgccactgatgcctgtaaccactttaccattagtcaattggctgtcaggctgcggttgtggctctggttgcggatttggctcaggattcggagtggtattgttatcggtcaaactatacagcagcttatttggtgttccttgagtgtcgctgactttgcctttggttgatcggtcgctaagcagcgttttgatttgattcggagagaggttcttattctcttgtaagtacaaggctgcgacaccagctacatggggtgaggccatagacgtaccactcatagtcgtcgtgccacctttatgcgacgccgaagtgacgtcagatcctggtgcgaagatctgtacacaattaccccagttcgagaagttagagcgaccatcattattggtcgttgaacctacagtgataccacttggttcacgtgcaggggatacttggcaagcatctttattatcgttaccagcagcaatgaccgccgtgactcctctttggacgagtcgagccactgcttgatccatcgcctgagatatccctccccctaaactcaaattggcaacagaagggccggacgcgttttgagccacccagtcaataccacgggcgatcgcttcagttgaaccactaccatcacatcccagcactcgcacaccaactaagttaacgtttttagctacaccgtattgagcgcccccgatagtgcctgccacatgtgtaccgtggccttggcagtcactggcatcattatcgttatcgataaagtcatagccggattttgctcgtccaccaaattcaggatggttgaaagcaataccggtatcgatcacataagcggtaacgccactgccatcatagttgtagttataactacgattgagcggtagatcgcgctgatcgatgcggtcgattccccaggttacgttatcttgagccgcatttgctgatgcagagatgatcggattaaccgtaataatttggttttgctcgatatagtcgacgttaggatcggcacgaagagcttgtagttgctcagccgttagctctgcagaaaaaccgcttaacgcactatcaaaaacatttttgatttcgagtgcatgcttattggctaatgcattgacagatcgttgagtaaattgttggaaagcttgcaaatcattactcatgattgtcgttggttgcttgagtacaacaatgtattgatttttaatgcctttccctgaagcggctttcatcaatggtgctaattgttgaggagatgatttgccaacaagctgattgggttgggcaagtgctgaggttgctgcgacggaaaacgtcgaaacaatgtataagcttaaaaactttttaaacatgataagtttccttaaaaagtgaataaaaatggttgggtcgtggctcacaacaatcatgttgagcacaccaataacgatctcatccttggatgaaaagaagttattcatgaaaactacttatgtttccacgtggggaggttaagtttgtattgttcgttttttgttcttcttttgtaagattaatgacaggaaagaaaggttcttcttattgatacatatagaatttttactctaatgctaatgtggttcaggattaagaattgaaatgttggtaatgtgtcaaataatgaattttgaattagattttttaatgctatatatctggggtggattgcctaatgtagcagcgagagtatgatttctccgttttttctagttaggttgtcgcactcgtgtcatctccatcttttcctcgtgttctgattttcgattctggtgtgggtggtctttccgtatatcgagaaattgaagcccgcttgccgcaattaaactatatctatctgtttgataacgcggcatatccttatggtgagctgacccaggaaacactgatcgcacgagttgatacgctggttactcgaatggttgaacaagagcgaatcgatcttgtggtcatcgcttgtaataccgcgagcaccatagtgttacccgtattgcgcgccaaactcacgatacctgtggtcggggttgtgcctgcaattaaacccgcctccctgattgctagcaaggcgattgggcttatcgcgacgccagccacagtgaaacggcaatacactcaagaactgatccgtgacttttccgccaacaaaaacgttgagctattggggtctacacgcttggttaatatggctgaagagaaattgcgtggtaagcctctcgatctcgaagaattagccagcatattgcaacccctgaagaacacgattgatgtcgccgttttaggctgtactcactttcccctgattaaagaagagatccagcaagtacttggagagcaagtgcaactgattgattctggtttggccattgcgcgcagagtgcaggagttgctgggaatagagcaagcggttggtgcaaagcaaaagcatcgaatttatgcaagcgcaccaccatgggaggaaagtgcgctgaacataaagcttgaacagttaggttttaatcctgttcagccatttcttcatccgatttaggatcattcgcaatgcgaacttttaacgttcgctgcatatattccttttcgttgagtgcatcaatggctgtttgagcttggcttgcggctatcaccacaaatccaaaccctcgccgtttacctgttcgtttgtctttcattaaacgcaccgcaaagacctcgccaaactcggcgaacagctctttaacgtgcgattcattggctttatagggcagattgcccacatagagtgttttcgtggtggaagacgcctcttcatcttcgcttgatgaaagagtggggtgagtagaaagtttgcaaattaaagccgttgcaaccacaccaattagaaaagcgaaagaagagtgtagagtcaattgcgataaaatcccggcaccaataacggcaagcagggcaatccataacatcgatttgtcagatttcatattgaattactacgcatcagagagaaagaagattcacggtctatcgatgaattaacaaaatagacacaggaatcttacgtatatgcttgatatttttccaatcgaatggtgtgacccccctcaaatgttgaaattttattcgaaaaacattccattgttgtctttttgagcgaacgattttatttgtcaaaaaaaagcttgtcataaaactctgtctccctataatgcgccctcactgacacggcgtgagattcaaatcacaaagtgaaagcaaaagagaagaaaaagttagaaaataacgtttgacactcaactgaataagcgtaatatacgcagccctagcgaattgagcttaaaagcgatttcgataggaaaagctctttaacaatataaaccaatcaatctgtgtgggcactcgttgatgataatcaaaaaagatttatcaatgaactgagtgaccatttgaatgagcaatcattcagcacagtcaattcactatcgaaagatagtatcagtattcattgagycgaagcgaaagcttcacaaaacttttaattgaagagtttgatcatggctcagattgaacgctggcggcaggcctaacacatgcaagtcgagcggcagcacagaggaacttgttccttgggtggcgagcggcggacgggtgagtaatgcctgggaaattgcccggtagagggggataaccattggaaacgatggctaataccgcataacctcgcaagagcaaagcaggggaccttcgggccttgcgctaccggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagttaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaatcgcatttgaaactgacaagctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgccctagaggtgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacacgatggttatcgtgatgagtgtccacacagattgattcggtttagattagagaagagtatcttagtgtcccgttcgtctagaggcctaggacaccgccctttcacggcggtaacaggggttcgactcccctacgggataccatctttaagcgttttcgctgagaatgtttaaaaatggttttcatcagaaaatcttgctctttaacaatttggaaagctgacaaaacaacaatttattgttgtttgtaaagttctcaatgtttatcgaaagataaacaccaacaacacattcaagtgtgcttggtatcgaataagacttcggtcttgttcaaatttgagtccggcaaaatctgtctcgcactcatgtaaattaaacgcgagacaacttaggttgtttaaacagcaacccgaaactccttcgggttgtatggttaagtgactaagcgtacacggtggatgcctgggcagtcagaggcgatgaaggacgtactaacttgcgataagcgcagataaggcagtaagagccgtttgagtctgcgatttccgaatggggaaacccaactgcataagcagttactgttaactgaatacataggttaacagagcaaaccgggggaactgaaacatctaagtaccccgaggagaagaaatcaaccgagattccggtagtagcggcgagcgaacctggattagcccttaagcactcggtgaagtaggtgaacaagctggaaagcttggcgatacagggtgatagccccgtaaccgacgcttcatcgagcgtgaaatcgagtagggcgggacacgtgatatcctgtctgaatatggggggaccatcctccaaggctaaatactcctgactgaccgatagtgaaccagtaccgtgagggaaaggcgaaaagaacccctgtgaggggagtgaaatagaacctgaaaccgtgtacgtacaagcagtaggagcaccttcgtggtgtgactgcgtaccttttgtataatgggtcagcgacttatattcagtggcaaggttaaccgtataggggagccgtagcgaaagcgagtcttaactgggcgctcagtctctggatatagacccgaaaccgggtgatctagccatgggcaggttgaaggttgagtaacatcaactggaggaccgaaccgactaatgttgaaaaattagcggatgacttgtggctaggggtgaaaggccaatcaaactcggagatagctggttctccccgaaagctatttaggtagcgcctcggacgaatactactgggggtagagcactgttaaggctagggggtcatcccgacttaccaaccctttgcaaactccgaataccagtaagtactatccgggagacacacggcgggtgctaacgtccgtcgtggagagggaaacaacccagaccgccagctaaggtcccaaagtattgctaagtgggaaacgatgtgggaaggctcagacagctaggatgttggcttagaagcagccatcatttaaagaaagcgtaatagctcactagtcgagtcggcctgcgcggaagatgtaacggggctaagcaatacaccgaagctgcggcaatgtcttttagacattgggtaggggagcgttctgtaagccgttgaaggtgaatcgtaaggtttgctggaggtatcagaagtgcgaatgctgacatgagtaacgacaaagggggtgaaaaacctcctcgccggaagaccaagggttcctgtccaacgttaatcggggcagggtgagtcgacccctaaggtgaggccgaaaggcgtaatcgatgggaaacgggttaatattcccgtacttctgactattgcgatggggggacggagaaggctaggtgggccaggcgacggttgtcctggttcaagtgcgtaggcttgagagttaggtaaatccggctctctctaaggctgagacacgacgtcgagctactacggtagtgaagtcattgatgccatgcttccaggaaaagcctctaagcttcagatagtcaggaatcgtaccccaaaccgacacaggtggtcgggtagagaataccaaggcgcttgagagaactcgggtgaaggaactaggcaaaatggtaccgtaacttcgggagaaggtacgctcttgatggtgaagtccctcgcggatggagctgacgagagtcgcagataccaggtggctgcaactgtttattaaaaacacagcactgtgcaaaatcgcaagatgacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccacgctgtctccacccgagactcagtgaaattgaaatcgctgtgaagatgcagtgtacccgcggctagacggaaagaccccgtgaacctttactacagcttggcactgaacattgaacctacatgtgtaggataggtgggaggctatgaagacgtgacgccagttgcgttggagccgtccttgaaataccacccttgtatgtttgatgttctaacttagacccattatctgggttgaggacagtgcctggtgggtagtttgactggggcggtctcctcccaaagagtaacggaggagcacgaaggtgggctaatcacggttggacatcgtgaggttagtgcaatggcataagcccgcttaactgcgagaatgacggttcgagcaggtgcgaaagcaggtcatagtgatccggtggttctgtatggaagggccatcgctcaacggataaaaggtactccggggataacaggctgataccgcccaagagttcatatcgacggcggtgtttggcacctcgatgtcggctcatcacatcctggggctgaagtcggtcccaagggtatggctgttcgccatttaaagtggtacgcgagctgggtttagaacgtcgtgagacagttcggtccctatctgccgtgggcgttggaagattgaagggggctgctcctagtacgagaggaccggagtggacgaacctctggtgttcgggttgtgtcgccagacgcattgcccggtagctaagttcggaattgataagcgctgaaagcatctaagcgcgaagcgagccctgagatgagtcttccctgacagtttaactgtcctaaagggttgttcgagactagaacgttgataggcagggtgtgtaagcgttgtgaggcgttgagctaacctgtactaattgcccgtgaggcttaaccatacaacacccaaggggttttgtagtggactcaaagctaagcgcataagaatgtgtgtgagaacgaagacagctttccagaattgttggttatcactttttaagaaaaagtgaaatcaaaaacagaatttgcttggcgaccatagcgttttggacccacctgattccatcccgaactcagaagtgaaacgaaacagcgtcgatggtagtgtggggtctccccatgtgagagtagaacatcgccaggcttttaatttggtctaaccagacagcggagcggtagttcagtcggttagaataccggcctgtcacgccgggggtcgcgggttcgagtcccgtccgctccgccacttattacgaaacccagtcttaggactgggttttttgctatctggaactcattgaacgccagattttaatcaccgcttatcgcctatcccagtactcatcctctacgatgttcaatcatcccaaactgtccaactgccgattctctgtttaatagatctagtttatgccttgttgcatagccacatcgagcaataaaaaagccgatgctttggcatcggctcggatagtgttatgtgattgattaaccgcgtagtgccgctttggcgaggagcgcttttttctctgaatcagagaggaaggccaactctaaaccgttgagctgagcttggcgtatctgctcttggcttaagcctgcttgaggtgctgcgacttcatattcgtaaggtagttcaataccttctacagcagggtcgtcggtgttaatgcaggctaaaataccatgctctaagaaacgcttaagaggatgtgtggctaggctatccaccgtgctcgtctgcaggttggaagtcaggcatgattcgataccgatccggtgctgggcgagatagtccatcagttttggatcatggatggctttgacgccatgaccaatccttgttgcgcccagatctctgatcgcttgccacatgctttctggccctgccgcttcacctgcgtgaacggtcacatgcaatcctgcatctctgacttgtttaaaatgttggataaagcggtcaccgggttgccccaattcatcacctgcgagatcgactgccacaatgtgatttttctggcttaggatggcgtcgagctcttgttggcaagcatcggtaccaaaggtgcggctcataatgccaataaggttggcttgaataccaaaatcacgcacaccagcgcggactccatcgacaacggcttctactactcctgtaacaggtaagctgtgtttcatggccatgtaataaggagaaaaacgtagctcggcatagtcaatacgggcgttaagcgcatcttcgacgttctcgtaggcaacacgacggcaagcatcaagatcgcctagtaccgctacgccccagtctagtttggataagaaggcaaccagagagggttctgcttcgacaatttgtacataaggggtaagagtttgtaacgtgtttgcgggtagcttaacgccaaatttttgtcctaattccaaaatggtttgggtgcggatatttccatcaagatgacggtgcaaatccgttaaagggagtgatgaagttatcattattgttgtccttatcagtatttgccgttaagtataaaaaccaatccacgggctgtcagctaagcaaaagaaagaaaaggacttattttgtttaactttgcttcatgttaaccagatctgttggccaatcctgataagccattggtttactgaataagaagccttgcccgcgtgggcaaccgagttgattcagtaaatccacctgctcttgagtctctatgccttcagcgaccagctcgactttaaaaccgcgagtcatgttaacgatcgcggctaccacgctgttttcaatattgtatgcattgagttgagagacaaattctctatcaatttttaggcaatcgaagggaagtttgtgtaagtaggcgagagaactatagcctgtaccaaaatcatcgattgcaatgtgtattcttgcttttttcaactcaagcatattgtgcaagataacggggtcattatcgacaatgcgtgattcggtgatttcgagtgtcaggttggtaggctgtaggccggattcgtctaatacgctgtgtaactgagcgataaaatcgggatgagagagttgattaaccgatagattgacatgcatatggaacgtcgatggccatttattttctgcaataccacgaacggtatcagcacaggcttgacgtaagatctgctcgccaatcgcattgatcaatccgctctcttctgcaatcggaataaaatccattggtgggatcaagccgaattcaggggaaatccaacgagcaagcgcttctgcgcctaatacttcaccactatttaaatcgactatcggctgatagaagggaacgaactcttgattatcgagcgccagttttatctgcgtgaccatgagcattcttttgcgtgaagcattcgccatctctggtgagtaaaaactgatatgcgtatgttctgcctttgcgttactgagggcgatgctaccattacgcagccaaacggtcatattcggttcttcaaggtacacaattccgatcgacacattcacagcaatattgtcgcttggcatgctaaatggagaggcaaacagcttgagaatatcggtagccacactttttaaatcatcttgctgattcacatcgggtaggtagatagcaaattcatcgccaccaatccgagcaatcagagcgggctcgggaaacgttactttcagtctttgagcaatagcaaccagcagttgatcggcctgatggtgacctaagctgtcgttaatatcgcgaaatttatcaatcccaatcaggataaggcccccgttgagttgcgggatttgatgacaatgctcaactaacccctctcggctaagaagttgggtcagagaatcgtagaccaactgtgagcgtagcgctttgaatgaggctttgaggctattggtcatctcaataaaggcttggacaagcaaactggtctcatagattttaccgggcttaggcatgctggctgtccagtcaccattggcaagttgtcttgctgccgaggcggtagaaatgatcgggttggcgacgcggtttaatgccattaagccgagccctaaacccactaagctcactaataatcctatcgcccaactggttttttgattttcaggtaagctgcctaggagatccccttccgcgatggaaacactgatataccaagtgaggccatattgatcggtaaaggctgaggcttgattgaaatagcgctgttgattgacgtaggtagtaaaagtacccacatttaggccttgcagatcaagttgttcggcgctgctacgaatgatggggttacgattctcgctggcgaacagcctttcacctttcgggcttaacggtgtcccccaagaaaccacgctaccctcaccggaatgggcaatcaggcggtgctgtttgtccatcacataaacgtcagcattcatacgttgtttgagttcggagagaaactggttgaacgtattgagtttgacatcagaaaccatgacgccaataaatcttttatcctgaaaaaccgggctgagtgcggagagagtgatctcttgcttctcatccatattggtataaaccgaagaccattgtggcgatggcttctgcgcgacgggggcaaaccaaggccgcacgcgaggatcgtagttatcaatcaccgtacgcaattgatcattctttgtcgcagtttgataaataactagtttatcgtcagtgcgtgcatctttgagcattaggctgtattgctctggtgcatctcgacgcagtcctacatattcaccattcactccaccaaaaccgaccacgtcgatttgctggatattgttacctatgggattggctgccgcacgaatgaagtcttcaattcgacttacgtcattgagctgataaagatggtgaaagcccacgttgtaggcaatcatctgattggcaaaaaaagggcgattaagaaagtccgacaagcgttgtgagatgctatcagtcagataagataacttcttagagctgagctcttttaccgtttgctcataacgataggtttgcaccgccgccattgccaaaatcatgaacagaaaggtcaagacaaacggcagtatgatggcggtttttaagcgaatttggcgttttaaaggcatacccttctctaatctcacttcctgtgcaataaagttgggtaggccgttaagctgacacttaatataactctttgagtttacgtgttagcgtattccgtccccagcccaatactttggcggcttcttgtttatgtccattggtgtggtgaagtgccgcttctaaaagtatacgttcaaattctgggagtgcgtaggcaagcaactcggtttcaccggaggccagtgcagattttgcccatgtttctaactgtttctgccaacttatatcattatcaaaatggctggctttcctttctgataataattcggaaggaagatcacttggcagcacttcacttccacttgccatcaccgtgagccagcgacacatgttttcgagttggcgcacgttacccggccaatcgagcttggtcagaatatccacggtgcgcgggttgagcgttttcatctccactccgagctctttggctgccagcgctaaaaagtgcttagtgagcttttcaatatcttgtcgacgttcacgcagtgacgggatatggatgcgaataacgttcagacgatggaataagtcttcacgaaatttgccttgatgaaccagtttttcaagattttggtgagtggctgcgacgattcgcacatcgacttttatcgcgacatgaccgccaacgcgataaaactgaccatccgccaacacgcgcaataaccgagtttgaatatcgagcggcatatcgccaatttcatcaagaaataaagtgccgccattggcttgttcgaagcgaccttggcgcacggtatttgcaccagtaaacgcgcctttttcatggccaaacagttcagattcgatgagatctttgggaatcgccgccatattgagggcaataaacggcttttgggcacgaggactatgtctatgcagagcatgagcgaccaattctttaccggttcccgattcaccgttgatcaataccgaaatcgaagagcgtgataagcgaccaattgcgcgaaacacttcttgcatagccggcgcttcgccaatgatttcaggggcggaatagttttcactgggacgatgagatgtcttgcgctgctcttgaccatgagcgatggcacgttcgactaaggtgagggtttcatcgacatcaaaaggcttgggaagatactcaaaggcaccttgttggtaggcattgacggcggcatccagatccgaatgcgcggtcataatgatcaccggaagttcaggggtgcgttggtgtacttgattgagcagagcaatgccatccatccctggcatgcgaatatctgagacaagaacgtcgggggtttcacgctccagtgccagcagtacgctttccgcatctgcgaaggtttcgcattttatatgggctgaagagagcgttttctccattacccagcgaatggaactatcatcatcgacaacccagacgtatcctctactcatagacaatccttaacagcaattcaaaattggcaaataaatggtaaacacggtgcgtcctggccagctttgcacctctatttttccctgatgttgatcgatcaggttttgtgaaatggataaccccaagccagtgcctccttcgcggccactcaccatgggataaaacagcgtatcttgcagctcaggagggatgccggggccgttatcgataatctcgatgctggcgacgagcttatgacgttgaccatggatattggcttgatgcactgttctggtgcgcaaggtgatcacgccgtgcgtttggttagtcaaaatttgcgccgcattactgacaatgttcagtaaggcttgttcgatttgatcagtgtccatcaaaatattcggcagacttgggtcataatcgcgctcaaagaccaaattcgcgcccgcttctagctcgaccaactgacgcaccttctccaaaatcaggtgaaggttttcccattttttctcccccggacgttgcgggccgagtaagcgatcaaccaatccccgcaagcgatctgcctgttcgatgatgatttgggtatattccatcagggccggatcgggaagcatacgctctaagagctgggccgcacctcttaaaccacccaaaggatttttgatttcatgagccaagcctctgaccaataacttagccgcttgttgctgagcgtgttgattgagttcttgggttagccggcgttgttgaccaatcgtgcgcatttcggccagtaacagcagctctttgtgccaagaaatcgggctgacggtgacttcgagcattaagggtttgctatcgatcaccaaggtgacatcgctgtcagtaatgctttgtccgctctggagtggctgcgtgagcagttgtaaatcgagagaggagtgttgcactaaatgatttaagctttgatgcatcaagcgtttagcactttgtgaaaacagctgttcagcggcagggttggcgtagcgaatcatcagtgactcgtccaaaatgagcactgatgtgacctgattattaatgatggtttggcttaattctgcactcacactcattctcgctcgatgaactttaggcttgttgggtgatgcacaaaattggtgcatcgcccaacaagtatggcgcaagggagtgcaaaccaaaagagcaatcccttaggcaatcgagctaatagtcacatcttgcgattatttcactgtagctcgatgcaaatgcaccgtgataatcgaggaggatgcaataatcttgccgctttcaatcgcttgaatggtaaaggtgtgagtgccgcgatcgacattttttaattcccaaactgattgggtggtgggggcaccatacgggcggccatccatcatcaattgcaattgctcaccgattgaaagttttcgattgagctcagagcgaatgaagagattgccgctattattgcgtaccgcatcgtcatgcttaggtgagattaaactgatttttagcggctccagagtttgaggtgcgggagatgctgtcgaatcggttagctctgtttcagaggcggtaacattgctaagccctgtttcatcctccgtttctgttgtgaccggctccgttgagtcgaaacttggcgcaggggcttgtgcttcataatccggtaactggatggattttgctttgtcactttgtggcgtgtcactaaagtgcaggacccctttttcatcgacccaagtgtagacgttttgtgcggcgagctgaggtacccaaagcacactaatgagtagccatagcagacgagacgatgacatatatcaccccaatgaccttaatgattcactttatggatcatgagcttatgctcatggttaacgttgtaagcggcatgttaaaacgaatactcaaaggactgaatatgcaaaaggcccgcctgcgaggcgagccttaatattgatgtaacctaagtcattttttacacagactgagaattacacagagtagtacagttcaaactcaagtggatgaacagcaacgttcacgcgctcaacatctttggtcttcagtgcgatgtaagaatcaatgaagtcatctgagaacacgccaccggcagtgaggaactcacggtctgcatccagatactgcagagcttgttgcagtgattccgctacttttggaatctctgccgcttcttctgctggtaagtcatacagatctttgtccatcgcttctcctgggtggatcttgttcttgataccgtcaagacccgccatcagcatagctgcaaacgccaagtatgggttagctgctggatctgggaagcgaacttcaatacgacgtgctttcgggcttggtaccactgggatacggatagatgccgaacggttacgcgcagagtaagccagcattactggtgcttcatagtgaggaaccagacgcttgtaggagttggtggatgggttagtgatcgcattcagcgcgcgagcgtgcttgatgataccaccaatgtagtacagtgcggtttcagataggccgccgtacttatcacccgcaaacaggttaacgccgtctttcgcgagagattggtgaacgtgcatacctgagccgttatcgccaaccagtggcttaggcataaaggtggctgttttaccaaaagcgtgcgcaacgttgtgtacaacgtacttgtagatttggatctcgtctgctttcgtggtgagcgtgttaaagcgagtcgcgatttcgttctgacccgcagtggctacttcatggtggtgcgcttcaacaaccagacccatttcttccatgatcaaacacatcgctgagcggatgtcttgtgatgagtcaacaggagcaactgggaagtaaccgccttttacgcctggacggtgacctttgttaccatcttcgtattcagtacctgtgttccatgccgcttctacgtcgtcaatcttgaagaatgaaccagacatgttggtggcgaatttcacatcgtcaaacaggaagaattctggctctggaccgacaagaactgtgtctgcgatacccgtagagcgcatatattcttctgcacgttttgcgatagaacgtgggtcacgatcgtaaccttgcatagtcgcaggttctaagatgtcacaacgaatgttcagcgtagcatcttcagtgaatgggtcgagcacagcggaagatggatctggcatcatcaccatgtcggattcgttgatacctttccagccagccacagaagaaccatcgaacattttaccgtcttcgaagaagtcagcatcaatttggtgagcagggatagagatatgttgttctttacccttggtgtctgtgaagcgtaggtcaacaaacttaacttcgttttcttggatcagcgataaaacattttctactgacatcttggataacctccggtgttaataagcggtatgggctcgagtcttaaataaagtcggcaaagattactgcgttgtactatgggtaaccgatgctgaaattaataaagcgaaaagcgtgccatgtttataaatccaatataattcatggttttggtgctggaatgtttgctttttgatgagcttgtgcaccaaaaagatcctcagttgcactatcatggtgcgtatgcagttgctctgcaccatgttttaccaaaacgtttgctatttcgcgctcaatcactggggatgtcaatggctgttaagccggaaaagtcagagataagtaaagatagcgagcgaaatgaagaaaaagtcgacgatttcagcgcgacagatcacatatttctaggttttccgctaaaatctggtacattattggccgtttttgaaccatgttcggcgactgttttaagcagccagcctcaatgaaaaagtgaagcaaaccccgatgaccactccgcaaattgaaaaattaagaaacatcgcgattatcgcgcacgttgaccacggtaagacgaccttggttgacaaactgctccagcaatccggcacgttagagtctcgcggtgatgttgaagagcgagtcatggactcgaacgacattgaaaaagagcgtggtatcaccattttggcgaaaaacaccgccatcaactggaatgattaccgtatcaacatcgtagacaccccaggacacgcggacttcggtggcgaagttgagcgtattatgtcgatggtagactcagtgctgctgatcgttgacgcggtagatggcccgatgccacaaactcgcttcgtaacccaaaaagcgtttgcacacggtttgaagccaatcgttgtgattaacaaaattgaccgtccgggcgcacgtcctgattgggttatggatcaggtatttgacttgttcgacaacctaggtgcgacggacgaacagcttgacttccaagtggtctatgcttcagcgctgaacggttgggcaactctggttgaaggcgaaacgggcgagaacatggaaccgctgttccaagccatcgtggataacgttgcggcgccacaagttgaccttgatggtccactgcaaatgcaaatttctcagctcgattacagctcttacgtaggtgttatcggtgttggccgtatcaaacgcggtaaagtaaaaccaaaccaacaagtgaccgttatcggtgcggatggtaagaagcgtaacggcaaaatcggtacggttctgggctaccttggcctgcaacgttctgaaactgaccaagccaccgctggcgacatcgttgcggtaactggtctgggtgagctgaaaatctctgacactatctgtgatgtgaatgctctagaagcgctgccaccactgagcgttgatgagccaaccgtaaccatgaccttccaagtgaacacctctccattcgcgggtaaagaaggtaagttcgtgacttcacgtaatatccttgagcgtctggaaaaagagctggtacacaacgtagcactgcgtgttgaacaaacggaagatccagacaaattccgtgtttcaggccgtggtgaacttcacctatcgatcctgatcgaaaacatgcgtcgtgaaggctttgagctggcagtatctcgtccagaagttattctgaagcacgaagacggccaactgatggaaccgtttgaaacggtcaccatcgacgtgcaagaagagcaccaaggcggcatcatggagaaaatcggcatgcgtaaaggtgagctgaaagacatgtctccagatggcaaaggccgtatccgtatggattttgtgatgccttctcgtggtttgatcggcttccaaactgaattcatgactctgacgtcaggttcaggtctgctgtaccattcatttgaccactacggtccacacaaaggcggcgtaatcggtcagcgtgtaaacggtgttctggtttctaacggtacgggtaaagcgctaacgaacgcgctgttcaacctgcaagagcgtggtcgtatgttcattggtcacggtgttgaagtttacgaaggtatggtgatcggtattcacagccgtgataacgacctgacagtaaacccactgaaaggtaagcaactgaccaacgttcgtgcttcgggtactgatgatgcgcaggttctaacgccgccaatcattatgtctcttgagcaagctctggaattcatcgatgacgacgaactggtagaagtaacgccagtgagcattcgtatccgtaaacgcttcctgaccgaaaacgatcgtaagcgtgcttctcgtgatgcgaagtaatcactgactttcgtttggtaagataagtcatctaagcccttagctgtcgccagttaagggctttatttttactgcgagagaattgactctggaggaaaggaatcgaatgtcgattgtgattatttctggcggcccaggtgctggaaaaaccactttgttgaatgcgctggcagagcgtggctatgccacctatccagaaatacctcgccaattgattgagcaagaaagcttaaaacaggatggcattttgccttggcatgatttgctcgcctttgccgaactttgctatgacgccatgttggtgcaaaagcagtctgcgcaaagtgcgtcgatggcgtttttggatcgcgcgattcccgatatttgtgcgtacttattgggcgcagaattggcggtgcctgccaaatattggtcagcgagctcgggctatcatccacaagtgttgatgtgtcaacccagcgccatcacttatcaacaagatgaagtacgaccatacacgctcgaagaggctgtgcacattcatcacgggttagtgaaggcttactcagggctaggttatcagtgtattgatgtgccaatggcatcgattgagcaacgtgtggcatttgtgttaaccgccttatccgtggcaggataaccgcaacccactgacaaggatgagctatgaaattgactcactcttttattaagcagcaggctcgattggggctgaactttttccgttacttattggcacggatgaaccatgatcgagtcaatgtgaatgccggttatctggcttatatcaccttactgtctatggtacccatgttgacggtcttgctgtcgatcctctcttcctttgctctttttgcgaacgctggagaagtaatccaagattttgtgatcacccattttgtgcctgcggcgggcgaagtggtcaaaaccgcgttaatcgagtttgttgccaatacgggcaagatgactgccgtaggcggcgcgtttttgtttgttgccgccatcatgctgatttccaatatcgataaaaatttgaactatatttggcgggttcagcagaagcgtcgcgcggtgttttcgttttccatgtactggatgatcctgacgctgggaccaattttagttggagccagtattgccgcgacttcgtatatcacctcgctcaagattttagataacgaagcgctttccggagtgtataacctgtttttacgctggttgccgtttgtgctctcttactgtgccttcgtcggtctatatctgctggtgccgaataaaaaagtccactggcagcatgcaatgctgggggctttgattgccgccatcttgtttgagttaagcaaaaaaggctttgccgcttatattactcagtttccttcttatcagttgatatacggcgctcttgctgcgattcccatcctctttgtttgggtgtatttatgttggttaattgtgttggtgggtgctgaggtgacggctgctttgggcgagcgtgaacactggagtgactcacaagacatgctacactttgcaccattaccaaagaatgaaaaagaatgaagtagaggaaaaacagagtgatagcactgatccaacgagtaagtgaagccgcagtacgggttgatggtgaagtggtcggcgcaattgataagggacttttagtgctactcggtgtcgaacgtgaagatgatgaagcgaaagccaagcgattggttgagcgagtgaccagctatcgagtgtttgaagatagcgaaggtaagatgaatctgagcgtgaaagatgtgggtggcagtgtgttagtggtgtcgcaatttacgctgccagctgacaccaaaaaagggactcgtgctggattttcgcgcggcgctgccccacaagaggctgagcggttatatgattatttctctgacctgtgtgcccagattttgccaaccgagcgcggccgttttgcggcggatatgaaagtgtcactgatcaatgatgggccggtgacgttttggctacaggcttaatttgcctcgtgttaccaaatgaataaccaagcgtgtcttgcgtaaggtaaggcacctgttcagggattgagtatgtttaaacttattacgccgaccacggataatcagctcaataagtacttccattttcgttggcaaatgttgcgcgagccgtggcggatgccgatcggttctgagcgtgatgaatacgattcgatgagtcaccaccggatgattgtcgacagccgtggctatccgatggcgattggtcgtctctacattacccccgattgtgaggggcagatacgctatatggcggtgaaagccaatcgccgctctaaaggtatggggtctttgattttggtcgctttggagtccttagcgcgccaagaaggcgccaagcgtttagtgtgtaatgcccgtgaagatgcgattccgttttatgctaaaaatggttttgagcgtcggggggaattaaccgatgaacgtggcccggtgcgccatcaacaaatggtgaaaaccctcgacccgatggccaatgtgctgcgtaagccggagtggtgtacggaactgcaagatcgctggggcaagcatattccgatcagcgataagatggggatcaagatccagcaatacacgggctaccaattccagtgctgcgcgcagcttaatccgaatctcaacccacataacactttatttgctggttcggcgtttaccctcgccaccttgactggttggggaatggcgtggctattaatgcgtgagcgcgatctgcagggggatattgtgttggtggatagtcatattcgttatcgccaccctgtagtgcaaaatccggtggcatcgacgtcgcttgatgggatcagtggcgatttagatcgcttagagtcagggcgcaaagcacgtattgtcgtacgggttatcatctccagcggagaggttgaagcgattgagtttattgggacctatatgctaatcccgaactacaaagcgttggtggcgcaaaaatcgtcatagcttcaccgagttcatcgcttccagtgcaagttcgcagcgcattatggcgcgctgcgacaatcttgactgactaattccgcttgttggaaatcccagcttaaccctaaacactgatcggcccacgcttgttggatcgtcaattgccattggccttgctctggttctaataggtcggtacttccccctaactgagcgtttaaatttggccctctaagcggcgttggtgtgatggttatgcgtcctctgtcagcgcttaccgcgagatcgtctagctcgaaaggctggatgatcagcgtgttatcactgcgcagtgagagtaagccttgacgcagattcagttgtagttggccatcaagcgaatgcgccagcatggtgcgatctcccgctatgccttgcgcggtcaagctaatgtcggccagcgcttccaaaccaaacggcagcttgaaccaagattgtagcggacctatcggcagagagtcggcatcaagagagagctgccacggggcgctgagcgaggttaagtcccattttgcatgtgcttcaacatagcctcgctcaagcggcagaaaggcgcgggtaagctgccatacgccttgctcactgcgcatattgagcacaccttgtgtactcagaacgcctgcatagctggcgctgttggcggtcactgagagttggccttgccaaaagccccattgactctctttcacccattgcagattttttccatcggcattcagccccgaggcttgccaaaatggccgattaacggtttgaatcatctgtaggttattgatatccaaatgctcaatttgcaagttttgccaagcggggagtggttgggagaaaggtaagagatcttgcggctgttcagcaatccatttcaccccagtgatggttaattgggcaaggttgaggctcgtttccgtgatatggcctttgacctgtacatcgccttgccaaacttggctatgcccatcaagctctattccttgcggggtaagggtcagttcagcactcggttcgacccattgggttgcaagccactgcgctgaatccgcattcaaggagaggtaagcttgctgctgttgccagagactgtgccgcaaatcgtagtcttccacagagagattgaggttctcccacgccacaccgttgagagtgagttggctattgagcagatctaaactgttgatgtgataaatactgggcgcaattgtttgccacaacgagtggtgacgccactcatcgagattgaggttaagacgactgagagtcacattgatcagcgaccagccttgtggatactgttccgcttgtcctgaaatggggctattgcgccagttgaacgaaaacccgtacacggtactgtcttgggcttggtaattggcatcaaccagcacttgattaaatgcttcaccatcgatagtgatttggtcggccgcgagctgaatttttccgtacggtaactgctgttggggtgagtcccaaactggctgcttgatctgtaagctgacgccacgcgcgataatcccttggtcagcccagtcaatattgtgcagcgccagttggttgagatggacagattccggcaaggtaaaattgggtaaaccgtgggcgaggttagcgccatcaattaatacgctatcgatttcgagttgttgttcaagcaagccataaggattcagccacaaatccatttgctgtaattcaatggtgggttcgctggcgatttgcaccccgctcaagcgcagtttaaacggataaaggtattcgattttggcaaagcgcagcgtttccggccacaactgctgcacaatccattgtgcggagggcgtgaagtagcgagtatgcataatgccaaatcccgctaagactaaaatcagtagtagtgcgatgcctgcgacaccaatcgccagtatttttctcatagtccctgcgttgctatcatcaaaattttgccagcacagaagatacggagtggctggcagcctgagttgttaaattgtaccgtattctcatcctcagcttggagtaaagcatgagagacagcaacaaaaaaagcccctcgaaagaggggcttgctactcagttatcacttttcggtcaatttgcctttagtcgagctttgggcccgcggcaaccagtgctttaccttcggcgttatctgtgtacttgtcgaagttgttgatgaagcgcgttgccaagtctttggctttgctttcccactgcagtgggtcaacataagtatcacgtgggtcgaggatcataggatcgacgccgggcagtgcggtgggcacttgcagattaaagattgggatatgtttggtttccgctttttcgatcgaaccatccaaaatcgcatcgataataccgcgcgtatctttaattgagatgcgcttaccgctgccgttccaacctgtgttaaccagataggcttcggcgcccgctgcttccatacgttttaccagcacttctgcatactgagttgggtgcagagtgaggaacgctgcgccaaaacaggcggagaaggttggggtaggttcagtaatgccacgctcagtacctgccagtttagccgtaaagccagacaagaagtggtacttggtttgctctggcgtcagttttgaaactggaggcaatacgccaaacgcatcggcagacaggaagatcaccttagtcgcatgaccgcctttggaaactggttttacgatgttgtcgatgtgataaatagggtaagaaacacgggtgttctcggtttttgaaccatcatcaaaatcaatcgaaccatcactacgaaccgtgacgttttccagtagagcatcacggcggatcgcgttatagatatccggctctgcttctttagacagcttgatggttttcgcgtagcagccgccttcaaagttgaacacgccatcatcatcccagccgtgctcatcgtcaccaattaacgcacgttttggatcggtggatagggtggttttacccgtaccagaaagaccgaagaagatggcgacatcgcccgctttacccatgttggcagagcagtgcatagaggcaatgccttgtagcggcaggaagtagttcatcatcgcgaacataccttttttcatctcaccgccgtaccaagtaccgccgatgagctgcatgcgctcggtcaggttaaacacagtgaagttttctgagttcagaccgtgctctttccacttcgcattggtacattttgcgccgttcattacgacaaagtctggtttaaagtgtgccagctcttcttcgcttggacgaatgaacatgtttttcacaaagtgtgcttgccatgctacttcggtgatgaagcgaacacttaagcgagtatcggcgttggcaccacagtagccatcgagcacaaatacgcgtttaccagaaagctgcttggtcaccaaggctttcaggtcattccacacttcttgattgatcggtttgttgtcgtttttcgctttgtctgacgtccaccacagcgtatcgcgagtggtatcatctttaacgataaacttatcttttggtgagcggccagtgaagatgccagtatcaaccgcaacagcacccaattcagtcaccacaccacgttcataaccttcgagatctgaacgggtttcttcggcaaataacatttcatagctcgggttacgaaccagttcagttacgccggtgatcccatattgggctaggtcgatttgtgcagccttagtatgttccataacggtcataggtgctccttgtaggattttgtagggattttgtaagattttatgtaattgttatctatagaccatgctagcaacggaccagagataaaacagggaggcagctcaaatattgcccaccaagtttctgtggttttaggtaactcgtcacatatattggcatcgatattttatcgcgtgcgcaaacctttgcgccagtagcacaagattaatactttacagaaattaagtacggcgtactgttgttaggttctttgattttattgattttttagcatgaaaaagccagcgataagctggcttttgggcggtttttacgtgcttgttaaacgtagcgaattaatgcaaggttgaaccgttcgccgatgagggggcatacaattcagcgacttgcgcagagtcaaacgagtaggtcgtaccgcaataatcacaatgcagagcgacggcaccatcttgagcaagaatatcgttaatctcttcacgtgcgacggtcacaatcgcggcagcactgcgttcacgtgagcagccacaacggaagctgatctgttgtggtgtgaacagttgcaccgtctcttggttgtaaagacgatacagcaactcttctgctggcagcgcaaaaagctcttcatccttgatggtgttagttaattgttctagatgctcgaaatcttcagctgaacctttaccatcgggtacgatttgcagcaacatgcctgcggcacaagctttcccatcgtgtttgccaacacgtatccataaacgggtcttaagctgctccgaacgttcaaaataaccttccaacacttgtgctaaggtgtcgccttccaaaccgaccacaccttgatagcgctcgccttgcttaggttcaatggtgatgaccagatgacctttgccaagcatgtcatgtaggcttgcatcatccgcaatatcacctttccagcgagccacgccacgcacttgttggttgttatcgccgttgatgaccacgagagagaccggtccattaccttgcagttgcagggtgattgagccttcaaacttcagcgtcgctgtcagcagtgaggtggcgaccagtagttcaccgatgaggtgttgtacggcggcagggtattcctgactggaaatcatctgttggtaagtgtcgtccagttgaaccaactcaccacgtacagaaaggtctttaaatagatagcgatgtagcatgttgttcgccattgattgtgtcgtcataaggaataatccggctatttactgatggatgaatttgagtagatctcggcgctgtttcttgtcaggacgtcgatccggactcgggttgagttggcgcatcatggcattgcgttcacgtttggtgatgctttcggccgtttcgcgatagagctgttgtgcttcaggtgccccacggcgttggtctgagatcttttcaataatgatcgttttctcatcatgaccttgacgcaatgtgatttgcgctccaatttcaaccgatttgctgggtttggcgcgctggccattatagtggactttgcccccttcgaccatatttcgcgcgagcgagcgtgttttgtaaaatcttgctgcccacagccatttatccagtctcacctcttctgcgctggaactcattgccacattgcctctctaagcttattacatttgactattattcatgcttaacaatggtgtttgcagggctgtttttcaagcaagtcgacaatttaacgtttgagacacttcgctccactatgcttgtgttatattgcgatgcctgcataaagtattgaaaaacatctgtacaaacagatttgcgcaatatgaagcgtaaaaagtacagaaaggaataacgtggaaatttatggaatttaaacaacttcctccgttggcagcgtggccacgtttattgagccagaatacgctgcggtggcaaaagccgatcagcgaaggattaacgctactgttattagttgcttcggcgtggacgctgggcaagatggtgtgggtcgtctcggctgaacaaacaccagtgccgacttggagccccacgttatcagggcttaaggccgaacgtcagccactcgatatcagcgtattgcaaaaaggtgagctgtttggtgtgtttactgagccgaaagaagctccggttgtggagcaacctgtggtggtggatgctccgaaaacgcgcttgagccttgtgctgtctggtgtggtggcgagtaatgatgcgcaaaaaagtttggctgttatcgccaatcgtggtgtgcaagcgacgtatggcattaatgaagtgattgaagggactcaggccaagctaaaagccgtgatgccggatcgggtcatcatcagcaactccgggcgtgatgaaaccttgatgcttgaagggttagactacaccgcgcctgcgacggcttcggtatccaaccctccgcgtccacgacccaatcaacctaatgctgtgccgcagtttgaggataaagtggatgcaattcgtgaagcaatcgcacgaaatccgcaggaaatttttcaatatgtgcgcctatctcaggtaaaacgcgatgacaaagtactcggctatcgcgtcagtcccggtaaagatccggtactgtttgaatcaataggtttacaagatggcgatatggcagtggcactgaatggcctagatctgaccgatcctaatgtaatgaacacgctatttcagtcgatgaatgagatgactgaaatgagtctgaccgttgagcgtgatggtcaacaacatgatgtatatattcaattttaacgctaaggcgagtaacgacgccttagtgaggcaagggagttcccagtgaaatattggctgaaaaaaagttcatggctgttggcgggcagtttgctgtctacccctctagcgatggcaaacgagtttagcgccagctttaaaggcaccgacattcaagaatttatcaatattgtgggacgcaatcttgagaaaaccatcattgtcgacccttcggtacgcggcaaagtcgatgtgcgcagttttgataccttaaacgaagagcaatattacagtttcttcctcagtgtgctcgaagtgtacggtttcgccgtcgttgaaatggataatggcgtactgaaagtcatcaaatcgaaagatgcaaagacctcagccattccggtgttgagtggtgaagagcgcgccaatggcgatgaagtcattacccaagtggtcgcggtgaaaaacgtttccgtacgcgagttgtcccctttgctgcgccaactgattgataacgcaggggcgggaaacgtagtgcactacgatccggcgaacatcattttgatcacggggcgagctgcggtagtgaaccgtttagcggaaattattcgtcgcgttgaccaagccggtgacaaagagattgaagtggttgagcttaataatgcatcggcagctgaaatggtgcggattgttgaagcgctcaacaaaacgacagacgcgcaaaacacccctgaattcttaaagcccaagtttgtggcagacgagcgtaccaactcgattttgatttctggcgatcctaaagtgcgcgagcgcctcaagcgtctgatcaagcagttggatgttgagatggcggccaaaggcaataaccgcgtggtgtatttgaaatacgccaaagctgaagatctggtcgaagtactgaaaggggtgtctgagaacctgcaagcggaaaaaggcaccggacagccgaccacttcaaaacgtaatgaagtgatgattgccgcgcacgctgacaccaactcgttagtgcttactgcgccgcaagacattatgaatgcgatgctggaagtgattggacagctagatattcgccgtgcgcaagtgttgattgaagcgctgattgtcgaaatggcagagggcgatgggatcaaccttggtgtgcagtggggctcgctggaaagtggttcagttatccaatatggcaacactggcgcgtcgattggcaatgtgatgattggtcttgaagaagccaaagacacaacccaaaccaaagcggtttatgatactaataacaacttcttgagaaatgaaacgacgaccaccaaaggggattacaccaagttagcctctgcattgtcgagcattcaaggtgctgcagtcagcatcgcgatgggcgactggacggccttaatcaacgcggtctctaatgattccagctcgaatatcctgtcatcacccagcattacggtgatggataacggtgaagcctcctttatcgtgggtgaagaagtgccggttatcacaggttctactgcaggctctaataacgacaacccattccaaaccgtggatcgtaaagaagtcggtatcaagcttaaagtggtgccgcagatcaacgaaggtaactcagtccagctcaatattgagcaagaagtctcgaacgtgttgggcgccaatggagcggtagacgtgcgttttgcgaagcgtcagctcaacacttctgtgatggtgcaagatgggcagatgttggtgctcggcggtttgattgatgagcgagctcttgagagtgagtcgaaagtcccgctcttgggggatattcctctgctgggtcaactgttccgctcaaccagctcgcaagtggaaaagaaaaacctgatggtgtttatcaagccgaccattattcgtgatggcgtgacggccgatggcatcacccaacgtaaatacaactacatccgcgccgagcaactgttccgcgccgaaaaaggtttacgtctgctggatgatgctagcgtgcctgtgttgccgaaatttggcgatgaccgccgccattcacctgaaattcaagcctttattgagcagatggaagccaagcaatgaccgaaatggtgatctctccagctgagcgacagtcgattcgtcgtctgccctttagcttcgccaatcgctttaagttggtgctggattggaatgaggatttctcccaagccagcatttattacttagcgccgttgtcgatggaggcgctcgtcgaaaccaagcgggtggtcaagcacgctttccaactgattgagctctctcaagcggagtttgaaagcaagctaacccaagtctatcagcgtgattcttcagaagcgcgtcaattgatggaagacattggtgccgacagtgatgacttcttctcactggcggaagagctgcctcaaaacgaagatttgctagaaagtgaagatgatgcgccgatcatcaaactgatcaacgccatgttgggcgaagcgatcaaagaaggcgcgtcagatattcacattgaaacttttgaaaaaacactgtcgatccgttttcgagtcgatggcgtgctgcgcgaagtactggcacccagccgcaaactctcatcgctgctcgtttcacgggtcaaagtgatggccaagctcgacattgccgaaaaacgtgtgccgcaagatggccgtatttcgctgcgtatcggtggccgcgcggtcgatgtgcgggtttcaaccatgccttcatcacatggtgagcgagtggtaatgcgtttgctggataaaaacgcgacgcgccttgatctgcacagtttgggtatgacggcgcataaccatgataatttccgccgtttgattaagcggccgcatgggatcattctggtgactggcccaaccggctcgggtaaatcgaccaccttgtacgcgggtttgcaagagctcaacagcagcgagcgcaacattttaaccgtagaagatccgatcgaatttgatattgatggtatcggtcagacccaagtcaacccaagggtagacatgaccttcgcacgggggctacgcgctattttgcgtcaagaccccgatgtggtgatggtgggggaaattcgtgatttggaaacggcgcaaattgcagtgcaagcctcgctgactggtcacttagtgatgtcgactctgcacaccaacacggccgttggggcggtgactcggctgcgcgatatgggcatcgagccttttttgatctcctcttcactgctcggtgttctggctcagcgcttggtgcgcaccttatgcccagattgcaaagagccttacgaggcggacaaagagcagcgcaaactgtttgatagcaagaaaaaagaaccgctgatcctttatcgtgcaacgggctgccctaaatgtaaccacaaaggttaccgtggccgaaccggtatccacgagctgctgctggtggatgacgcgttgcaggagctgatccatagcgaggcgggcgaacaggcgatggagaaacacattcgcgcgaccacgccgagcattcgtgatgatggtctagataaggtgcgccaaggcattacttcgctagaagaagtgatgcgggtgactaaggagtcctaatggccgcgtttgaatacaaagcgctggatgccaagggacgccataaaaaaggcgtgattgagggcgataatgcacgtcaggtgcgtcagcgcctgaaagagcaaagcctagtgccgatggaggtggtggagactcaagtcaaagccgcgcgcagtcgcagccaaggttttgcgtttaagcgtgggatcagtacgccggatctggcgctgatcactcgccaattggcgactttagttcaatccggtatgccactggaagagtgtttacgcgcggttgccgagcagtcggaaaaaccgcggattcgcaccatgttggtggcggtgcgcgctaaagtgaccgaaggttacaccctctctgatagtcttggcgattatccgcacgtgtttgatgagctgtttcgttctatggttgcggcgggcgaaaaatctggccacctcgattccgttctcgaacgtttagctgactacgccgaaaaccgccagaaaatgcgctctaaactgcaacaggccatgatttaccctgtggtgctggtggtgtttgcggtcggtatcgtggcgtttttgttggcagcggtagtgccgaaaatcgtgggtcagtttgtgcaaatggggcaagccttgccggcatcgactcagtttctgcttgatgccagcgatttcctgcaacattgggggatttcgctgctggtcggtctcttgatgctgatttatctggtgcgctggttgctgaccaagcccgatattcgtttgcgttgggatcgccgagtgatttccttgcctgtgattggcaagattgcacgcggtctgaatactgcgcgctttgcgcgtacgctgtcgatctgtacctcaagtgcaatcccgattctggatggtatgcgcgttgcggtggatgtgatgaccaatcagtttgtgaaacagcaagtgttggctgcggccgaaaacgtacgcgaaggctctagcctgcgcaaagcgctagagcagaccaagctctttcctcccatgatgctgcacatgattgccagtggtgagcagagtggagaattggaaggcatgttgacgcgcgctgcggataaccaagacaacagttttgaatcaacggtcaacatcgcgcttggcatttttaccccggccttgattgccttgatggcggggatggtgctgtttattgtgatggcgaccctgatgccgattttggaaatgaataacttaatgagtcgttaagtcgtcacgcgcggcgaaaacgacatagtgtggagtaactatgaaaaaaatgcgtaaacaaacgggctttaccctgctcgaagtaatggtggttgtggtgattttgggcattctggccagctttgttgtccccaacctcttaggtaacaaagagaaagcggatcaacagaaagcggtgaccgatatcgtcgcgctggaaaatgcgttggatatgtacaagcttgacaacagcgtttacccgacgactgatcaaggtttggaagcgttagtgactaagccaaccaatccagagccgcgtaactatcgcgaaggcggttacatcaagcgtctgcctaaagatccttggggtaacgactaccaatacttgagcccaggcgataaaggcacgattgatgtgttcaccttaggtgcggacggtcaagaaggtggtgaaggtaccggtgccgatatcggtaactggaatatccaagattttcaataagcttggctaattagcggtaactgacggaaccttatgacagcgacacgcggttttactttgttggaaattttgctggtgctggtgctggtttcggccagtgcggtggcggtcatcgccacctttccggtttccgtcaaagatgaagccaaaatcagtgcgcagagtttttatcagcgtctgttgctgctcaatgaggaagcgattctcagcgggcaagattttggcgtgcggatcgatgtcgatacgcgccgtctcacttttttgcaactcaccgccgacaaaggttggcaaaagtggcaaaacgacaagatgaccaaccaaaccacccttaaagaagggttacagctcgactttgaactcggtggtggcgcttggcaaaaagacgatcgtctgtttaatcccggctctctgtttgatgaagagatgtttgccgatgagaaaaaagagcaaaaacaggaaccggctccgcaactgtttgtgctatcgagtggcgaagtgaccccatttacgctgagcattttccctaaagggcaggagcccgatgagcagtggcgagtgaccgcgcaagaaaatggcactctgcgtctactggctccgggagaaagtgatgaagagtaaacgcggttttactttgcttgaagtgctggtcgcgctggcaatttttgctaccgcggcgatcagtgtgatccgctcggtcagtcaacacatcaatacggtcaattatcttgaagagaagatgtttgcggccatggtcgtggataaccaaatggcgcaagtgatgctcaatccgcaatctttagcggcgcgtgagggcagtgagcagatggccggacggacttggtactggaagctgagtcctgtcaaaaccgccgacaatctgctcaaagcctttgatgtcagtgtcgccacagaaaaaggcgcgaccccagtcgtgacggtgcgtagctatgtggcgaactaaccaagtatcttctcgccagaatatggcgggctttactttgattgaagtgttggtggcgattgcgattttcgcgagcttgagtgtgggcgcctatcaggtgctcaatcaagtccaacgcagcaatgaaatttctgccgagcgcaccgcgcgtttggctgaattgcaacgcgccatggtgatcatggatgccgattttcggcagatggccctgcgccaatttcgcaccgatggcgaagcgccgagtgagcaaatcctacaatggaaagaatcgctgctcgattcggatcagcacggtttgttgtttgtacgcttgggttggcataacccacagcaacaatttccacgcggtgaagtggcgaaagtcggttaccgcctgtttgaaaaccgcttagagcgggtctggtggcgctacccagatactccagcggggcagcaagggctgatctctccgttgttaactggggtggaagattgggcagtacagttttatttgcaaggtgaatggagtaaggagtgggtgcccactaacgccttgcctgaagccgtgaaagtgaccttgcgcctaaaagattacggtgagattgagcggatataccttacagggggcggttcactcaatatgacgcaagagagtgttgaaaatgcgggctaaacagcgcggcgtggcgttaattgtgattctgctcctgctggcggtgatggtctcgattgctgcgaccatggccgaacgtctgtttagtcagtttcagcgtgccacgcatcagctcaactatcagcaggcttattggtacagtcttggcgtcgaagcgctagcgaaaaaaggcattgagcagagctaccaagacagtgaaaccatcaatttgagtcagccttgggctttgaaagagcaaacttatccgctcgattacggacaggtgcgcggcaaaatccgcgatatgcaagcttgctttaatctcaatgcactcgcgggggtaaagctcacgccagacagcgtgaaaaaaccgtatttgctgacggtgctgcaagcgctgcttgaagggctggaagtggagagttatcaagcggaagtgattgccgattcgacgttagagtttattgataaagatgactctgtacgcaccgcttatggggtggaagacagttactatgaatcgatgatcccggcctatatggcggcggatacttggttggccgatgcgagcgagtggcgtgcggtacagcaagtggggggagaaacgatgaataaagccttaccttatgtgtgtgcgttgccaaccgatcaatggcgcttgaatgtgaacacgttacccgctgagcaagcggcactgctggcggccatgtttagcccaacattgagtccggaaagcgcgaaaaccttgctcgaagggcgacctttcgatggttgggcgagtgtggatgattttcttgcccaatcggcactcaccggagtggataacgcggtgcgtgaggaagcgaagaaatacctcagtgtagatagccattattttgaattagatgcacaggtgctggtcgatacgtctcgcgtgcggatccgcagcctgttttacagtaacgataagaaaactgcgacggtgatacgccgccgctttggagggatcagtgagcgagtttctgaccgttcgactgagtagtcaaaaagaggccgatatcccttggctggtttggtctgccgagcagcaagaagtgattgccagcggccaagtggctggttgggaagccttgcatgaaattgagtcttatgctgatcagcgcagcgtagtggtattactggcggcgagtgatttgattttaacgtcagtggagatcccgcccggcgcttctcgtcagcttgaaaatatgctgccgtatttgttagaagatgaaatcgcccaagatgtggaagatgtgcacttttgtgtgctgagtaaaggacgagaaacggcggatgtggtcggtgtcgatcgtctttggctgcgcgcttgcttagatcatctcaaagcgtgcggttttgatgtgaagcgcgtattgcctgatgtactggcgatccctcgcccagagcacggtttagctgccctgcaattgggtgatgagtggttagtgcgtaaaagcactacgcaagggatggcagtggacgcgcagtggttaagcttactggccgcttccgattgggtgcagaatgagggtgagtatttgcctttgcaagcgctcacgccgcttccagagctgagcttagccgaaacccaagagtggcgttatgagccgagcggtttagtcatgcaactgctgactcaggaggccttaaccagcaagttcaacttgctgacggggagttttaaactcaagtcttcttggctgcggtattggcaaatatggcgcaaagtggcgatcgctgctgggctatttgtcgcggtatccatcagttattcgctgtttcaggcgcatcaatacgaagcacaagcggacgcttaccgcgcggaaagtgagcggattttccgcagcatcttccctgataaacagaaaatcccgaccgtgacttatttgaaaagacagatgagtgatgagatggcgcgtttatctggcggtgccagtgtgggcagcgttttgaagtggctaagcccgttgcctgaggctttgaaaggggtcaatctacaactgcaaagcatcaaatttgacagtaaccgcagtgagattcgcctagaagcgaccagtcgtgatttccaaagttttgaacaagctcgcactcagcttgagcagtattttgctgttgaacaggggcagctcaataaaaatggcgagcaagtgtttggcgtgtttgtggtgaagcccaagtaaggagaaatgatgaaagaattattggctcctgtgcaggcttggtggcgaagtgtcacccctcgtgagcaaaagatggtaatgggcatgggcgcgctgacggtactcgctatcgcttattggggaatatggcagcctttgagtgagcgtaccgcccaagctcaagcacgattacaaaccgaaaaacagctactgagttgggttagtgaaaacgccaacgacatcgtaacgctccgtgcgcaagggggcagtgatgcgccaagcgatcaaccactcaatcaggtgatcactaattcgacgcgtcagttcaatattgagctgatccgcgtgcagccgcgcggcgaaatgatgcaggtctggatccaaccgctaccgttttcgcaattggtctcatggattgcgtatttgcaagagcgccaaggggtgagcgtggatgcgattgatattgaccgtggtaaagtgaacggcgttgtggaagtcaaacgtctgcaactgaagcgtggaggctgatatgaagcgtgctgttggctatggtctgttattttccacagtgttaatgaccagcgtggtcgtgcatttgcctgcccaagtggcgcttagcccgctaccgctgcctgaaggtttagagctcactggtatagagggtactctgtggcaaggtcaagccgcgcaagttcgttggcaaggcatgagcctaggcgatctcaactgggatctccacctctcggcgttactgttggggcagttggaggcggatatccgctttggccgcggtagcagcacacaactaagagggaaaggtgtcgtgggggtcggtttgagtggtccctatgccgatgattttttactctccttaccggctgcgcaagccattacttggctaccgctaccggtaccactgatggcgcaagggcagttggagatggccgtcaaacagtaccgctttggtgagccttactgccagcaagccgaaggcagcttagcttggtcagccgcgcagctagaatcgccgattggtgcgctgcagcttggtactgtcgtgtcggattttacctgccaagagagcgttgtgaccctgaaaggtggccaaaaaactgcgcaggtgagcagtgaatttaacctcagtttacagccggacaatcgctatcaagcacaagcgtggtttaaaccagaagctgaatttcctgagagtttaaaggagcagttgagctggctaccgcagcctgatgggcaaggtcgctatccgttcaatcaacaaggtcagctctaggatgtgttatcccattcatttcacgcccaactgggcgtgaaattttatcggctagtctttgatttttaagatctcattccaaggtaaatccgcatcaccaagcacgatgaagttcgggttttccaaggtttcccgctcattgtacgagaggggcgataattgagtgctcagaatgcgcccacccgcttcttcgacaatgcactgggttgcggcggtatcccattcgccagttggaccaaggcgcagatagcaatctaccgcaccttctgccactaagcaggctttcagtgctgcagagcccagtggcaccaagtcataattccaagcactgcttaaacggcgcgtgattttgttgatgtcttggcgacggctgatggcaatcgcgatcgagctgctcggcagctcatgtttgtgagtctgaattttgaggctctgcgccatgtcggggatcttccacgcccctttgcctgcgtaagcgtagtaagtcacaccagaaacggggccatacaccacccccatcaccggatggttattttccacgagcgcaatgatggtcgcgaagtcgccgctacgtgcgatgaactcttgagtgccatccagcggatccaccagccaatagcgctgccatgtttcgcgagtggcaaggtcgatattggcttcttcctccgagaggatcggaatatcaggggtcagctcgcgcaactgctcacacagaaacttatgtgcggctaaatcggcgctggtgacaggcgttgaatcacttttggtgaaggcttcataagatttattttgatagatatcgaggatgagttgccctgccgctcgcgcgatgttaatgacatcgggcagtaagtgcgagagatcctgtggtgtagacatagtgactccgaaggcgtgcgattcacgcctgaagaaaacgcagagccaacagcaaggctgtgatgctgcgcgcttcacaaaaatcgagatgggtcagcagatcttctgcttgtgctaaaggccagcgaatgatctccaacggctctggctcatccccctctaactgttctgagtatagatcctgagcaacaaaaagaaccattttactggagaagtaagaaggagccagcaccacctctttgagcggcgttaactggcgcgcgccaaaaccaatttcttcttttaattcacgattggccgcttgctcggcggtttcaccatgatcgaccaagccttttggaaagcctaattcgtaacgctccgttcctgcagcgtattcgcgcacgaggagtaaatcaccttgggctgtgatcggcaccatcatcaccgcatgacgaccgctcggcttcatacgctcgtaagttctttgttcaccgtttgagaaacgcagatccaaagcttcaatagtaaacagacgcgatttggcgaccgtttcacgatccagaatttctggtaaagatttggatgacatacgcagactcctgagcaaaaaagttttcttaatatatgagaaataatcacagtttgaaacgctcaatatgccgacaccaataaaaaagctgatgtgaatacatcagcttcgaattggagtgataggcaggctgaacgcttagtagtaagagtgctcaccgcgatcgtgctcggtggagtcacgtaccgcagtcagttcaccagcaaattgagccagcagctctttctcaatgccttctttaagcgtaacgtcgaccatagagcagccgttacagccaccgccaaattgcaccagagccacaccatcatccgaaatgctgatcagacgaacgtggccaccatggccggccaattgagggttgacttgggtttgcagggcgtattctacgcgctccatcagcgaggcatcgtcagaaactttgcgcattttcgcgttaggggctttcagggtcagttgtgaacccattttgtcggtgacaaagtcaatcaccgcttcttccaaaaagggcaagctaagttcatcaacataggcagaaaagccactgaaagggtattccgtatcagtcgcttctacggcttccggtgggcagtaagagacgccacactcggcattttgggtgcctgggttaaccacaaacacacgaatattggtgccttcaggctgctgagccagcagcttagcgaagtgagattgggcagattcagtaatagtaattggatttgacacgacgaatacctgagtaaaagaataggttattgctcaccattctactcctgagttagcgatgatccagcccttttgcgttaaaaaacgtcaaccgtggctatctttcggctcgggagtgcggcatatgcagtaaatatcaatgctttgcacaccgacatcaagcagtaaatcgcataaatgtcggatcgtactgcctgtggtcaccacatcgtccacaatcgcaacatgtggttggtttggcggatgattcagcacaaacgcatcgcgtaggttgtggattcgctgcgccttgctgagtccttgttgatgcggtgtcgctcggcggcgtgcaaagagttggtggtcatattcaacgttcagcatattggctaactcgcgcgccagcagatcgctttgattaaagccgcgttgccagcgtcgccgccaatgcagtggcacgctgcacagcaacggggctggctcgttaatctgggtggcgagtagcttagccaagcgcggcgcttgccaaaactggcgttggtatttgagttgatgcaccgcatcactaagtggaaagcggtaatcgccgacacacatcagttttcgccacggcggaggctgacccaaacactgcccgcactgatcaactggggtaagagtcggtaaaccgcagcgtgcgcagcgataaccgtgctcaagccaagcttggcaggcagagcagacgccaaacggcgaatttgtatctagcgccagtcgacagagatgacattccggagtcagcagtggtgcggtagtttttctgagccaatgggttaacatagcgagccaagaatcggggtaatgtgcttcatcttgccaattggcagagtggatgaagatggaaatagacggagaaactgtgaccatggcgttgtattggcaagtcagtggacaagggcaagatctggtattggtacacggctggggcatgaacggggcggtatggcagcaaaccgcacaagccttgagtgaccattttcgagtgcatgtggtggacttacccggttatggtcatagtgccgagcaacatgccgcaagcttagaagagattgctcaagccttgttagagcatgcaccgcgcaacgccatttgggtcggctggtcactgggtggcttagtcgccacgcacatggcgctgcatcattcagactatgtcagcaaattggtgacggtcgcttcctcgcccaaatttgcggcgcagggcagctggcgtggtattcaaccggatgtgctgaccgcgtttaccgatcagttggtggccgattttcagctgaccattgagcgctttatggcgctgcaagccatgggtagcccaagtgcgcgccaagatgtgaaagtgcttaaacaggctgtgctgtcgcgccctatgcctaatccacaatcattgctcgcagggctgacgatgctcgccgaagtcgatttgcgtgatgagctgcaacacatcagcgtgcctatgctgcggctatatggtcggttggatgggttagtccccgcgaaagtcgcccgtgatttgaaccatttagcgccttacagtgaagcgttcatgtttgaccaatcttcccatgcgccgtttatgaccgaggcggaggcgttttgtcagcagcttatcgagtttgcgactcgttagatccccccttcctactttaagctgtcactccaagtcgtttgggggagtgtgaattttgtcgcgctgaccaaaatttgactcaatcattttcggaacaggtcgataaatagactaacccggagtgaaagccgagggtgggcgaagctgaggaggtttcggctatgctagtgtcaccgaccaatgtcagtgtgccgctgatcgccccatcagtgaacgtgcaaacggagcaggccgcacgcgacaatcgcgttcgcgagccagtgacgccaaccgtacaactggccaaatcgaacgctgaacgtaagatcaaagaggatgataagcgtcgcaagcaaccatcgtgggatccagcagaacacccacgttatgatatcggcggcgaagcggaggcgcagacctcccatcacgatgaaccgaaaagtgagcttgagcgattgtttgatctgctcgcactcgcttcgtacagccaagagcaaggcaaaggttatgcgatgcgttttcgcttacctaagcacatcattgatgcggcgataacagaaggcaaaatggcgcgccggcgtgtcgtgatcaaatactattatggtcacgcagtggcacccaacacaccttcagacgtgattgcggttttgtaggtgagttatctcgcgcaataaaaatccccacagctgtggggatttttttatgcagcataacggttaggtcatgatgaaatgtgtttgtcggctatttcttcgctttagcgaaagcagcggcaaacgcaccgcccatggcaccacccagtgcattgccttgcggctcatcacggcgtggagcgcgacgctcttgccctgagcgtggcgcagcgctgcgttggctgcggttatcttgtcccggctcatcgtttaagcgcatcgaaagggcgatacgcttacgctgcacatccacttccatcactttgactttgacgatgtcaccggctttaaccacttcacgcggatctgagataaagcgatcggtcagcgcagaaatatgcactaagccatcttgatggacgccgatatccacgaacgcgccaaagttggcgacgttagagaccacgccttccaacaccatgcccacttccagatctgacacctcatggatgccttcagcaaaggtcgcggttttgaattccggacgcgggtcacgccccggtttatccagctccttgatgatgtcggtcacggtgggtacaccaaagttttcatcggtgtaatcgaccgcgcgaagagtgcgcaggaactctgtattgccaatcagcgctttcagatctttgctgttcttctcagcgatagttttcaccaccggatacgcttctgggtgcaccgctgaagcgtcgagcgggtttttgccatccataatgcgtaggaagccggcacactgttcaaacgctttaggccccaaacgcggcacttttttgagggcactacgcgactcaaaacgaccgttttcatcacgataatccacaatgttttgcgcgagtgctgcagacaagcccgcaacacgagtcagtagcgctgccgaggcggtattcacatccacacctacggcgtttacacagtcctcaacaatcgcatcaagacgtttcgcaagcagggtttggctcacatcgtgttgatactggccaacccctatcgatttcgggtcgatcttcactaattctgcgagtgggtcttgcagacgacgcgcgatagagactgcgccacgcagtgacacatcgagatttgggaactctttcgccgctagctctgaagcggaatacaccgatgcgcccgcttcgctgaccatgattttttgtactttgagattgccgcgcttgattaaatctgccgcaaaagcatcggtttcacgcgacgccgtaccgttaccaatcgcaatcagatccacgttgaactttttcaccagcagagcaatagactgcatggcgcgatcgtattgatgctgtggtgcgtgcgggtaaatcgtgtcggttgccagcactttaccggttgcgtcaaccacggcgactttacagccagtgcgcagacccggatcgaggcccagtgtcgcgcgaggacccgccggtgccgccatcagcagatcttttaagttggtggcgaacacttcaatcgcttcgatttccgcgcgctctttcatcgcgctcatcagttcggtttccatgtgcatggagattttgattttccatgcccaactgatcacctgcttgcgccacgcatcggccgtcgcttggctcaaatgaatgccgtaatgctcggcaatcagagtttcgcagtaggattggcgcgcactctcttccaattcaggatcggcattcagcgttagggttaagaagccttcgttacggccacgcagcatcgccaacgcgcgatgtgaaggcgctttgctgatcggctcgcggtgatcaaagtaatctttaaatttctcgcccgcttgctctttaccctcgatcacgcgcgacacaatttccgcgttgcgattgaggtgctgacggattttttccagtaggttggcatcttccgcgatgcgttccatcacgatagcgcgtgcgccatccagtgcggctttgctgtcggcgacgcctttctcggcattaatgtattttgccgcttcgctttcagggtcagtattaggctgcgtccacagcgtatcggccagtggctcaagacccgcttcaatcgcgatttggcctttggtgcggcgtttcggtttgtaaggcagatagagatcttcaaggcggtttttgctgtcggcacttaaaatcgcctgctccagctcaggggtgagtttgccttgttcttgaatcgatttgaggatggtttggcgacggtcatccatctcacgcagataggcaagacggctatctaagttgcgcagttgggtatcatccaatcctcccgtcacctctttacggtaacgggcgataaaaggaacggtattgccatcgtcgatcagggtgacggcagcgataacttgctcagggcgaacattcagttcttgagcaatctggtggcagatagctttgctcatccgtggtggtctctttttgacattttcggtttatatgggggcagttacgcctgactccagctcaacgtttgaatggaagaggagtttgagcctgccctctagacagttactgataataggcggctattaataacacgtctgctgctcgcttttgagagctttcagtcaaatcttttgccctgactggcaaagcgtgcgaaaaatcggtacttttcgcgcaaccctattttgttgagaatcccgtgtgaaaactaagctgattacccgagctggctataacaagctcaagcaagagctcgactatttatggaaagaacaacgtcccgagatcacccaaaaagtctcttgggcggcgagccttggcgatcgctcagagaacgctgattacacctacaacaaacgcctgctgcgacagattgatcgtcgtgtacgcttcctgagtaagttgctgccagagctgaaaatcgttgattattcaccgcagcaagaaggcaaagtgtttttcggtgcttgggtggaaattgaaaacgaagccggagaggtgaagaagtttcgcattgtcggccccgaagagatttacggtgatgccaaagattacatctcgattgattccccgatggcgcgcgcgctactcaaaaagcaagtggatgaagagtttcaggtgcacaccccgacgggcatcaaagagtggtttatcaactcgattgagtatgagaaaggggaattgtgagatcgtgtattgtggattcgtagcctatccgctacaaagacataaagattaacaattctttgctcccggtgagcggtaacgatgttacattttactcgcccgaagagtaggggattgaacaacagttaggtgggatcatggtggaaaatcataaagttttagtggtagatgatgatgcgcgcttgcgtgcgctgcttgagcgttacctgtccgagcagggttttcaagtccgcagcgtggctaacggcgagcagatggatcgtctgctgacgcgcgaaaacttccatttgatggtgctggatttgatgttgccgggtgaagatggtctttctatctgtcgtcgtctgcgcaattccaacaacatgatcccgattctgatgctcactgccaaaggcgatgagattgaccgcattgtcggcctagaagttggtgccgatgattacctgcctaagccatttaacccacgtgagttgctggcgcgtatcaaagcggtattgcgccgccaagtgattgaagcgccgggagcgcccagtgcagaagagaccatcattgaatttggtgagtttcgcttaaatcttggtacgcgagaaatgttccgtggtgaagaggcgatgccactcacttctggtgaatttgctgtgttgaaagcactcgtgaccaatgcccgtgaaccgctttcgcgcgataaactgatgaacatggcgcgtggccgtgaatattcagcgatggagcgctcgattgacgtacagatttctcgtctacgtcgtatgctcgaagttgaccctagcaaaccgcgctatattcaaaccgtatggggactcggttacgtgtttgttcctgatggtaaagccgccaactaacttcttttaggcacgccgggcaagggcgtcctcgctccgcgcgtgcccttgctacatttaggtgccttatgcgaattcgcagttcatttacccaatcgatccttctgtttttctctctgttgatcgccagtcaaatttattcttactacgccgtctttaactatgcgttgctgccgagtttgcagcagttcaacaaaattcttgcccatgaaatcagcttgatgctcgatgacaccagtaatcccaatgtcagttcagaaatggatgcgttgctcaaaaggcgtgtgcttgagcaattaggggtgacgattcatagtaacgacagccccgaagcggtcgaatatcaacacgcgatcagtttggatttgatgagcgaagagatgagtagtgagctgggttcacccacagaagtgcgcatggcgttgggcgaagagagctacatcctgtggatgaagatcgattctctgcccggccagttgctgcgtattccactctcagagctgcaggaagaagatttcgcgccgctgtttcgtaacagcattattatggcgctactgattgtaattggtggctggctgtttattcgtctgcaaaaccgtccactgattgccttggaaaaagccgccaaaatggtaggtcgtggagaaacgccaccacatctacctgagcaaggcacgctagaaatccgctcggtaacgcgcgcgtttaatcgaatgtcgaaaggcattcaagcattggaagaagatcgcgcgctgttgatggcggggatcagtcatgacatccgcacgcccctgacccgcatccgcttggcaaccgagatgatgtcgccagaagacagctacctagctgagagcatcatcagcgataccgaagagtgtaaccagatcatcagccaatttatggattacctcaaacccgtcaatcgtgaagcgtttgaagcggtggatttgaatgatattgccagcgatgtggcaagctctgaagggggctacgaagtgcagattgaaaccgagttacaagcaggactcgcgcccgccctgggcaacccgattgcgattaagcgttcactcagtaacttggtagtgaatgcgctgcgctacggcaacggttgggtcaaagtgagtagcggcatgacggccgataagaagctagtctggctgtctgtggaagacaatgggccgggtatcgatccaagccaagtaaataaagtgtttgagccttttactcgtggggataccgcgcggggtagtgaagggacgggcttagggctggcgattgtgaaacggattgtcagccagcatcatggtgcggtgtcggttagcaatcgcagccaaggtgggctgcgtgctcaaatcagtttcccgactaagcagcaaaagggctaacctaagttagccctgaatgaacagctagtttgattcttgcgccgcttccgttttcgctactgaagcggcgtcttcatctcggcgcacctcaggtagcagcaggttaagcacgattgcagtaataccacctgcggctacacctgaagagaacagattcttaataaattccggcataaactgcagaatctctggcttttgcgcaattcccaaacccattgagaaggagagcgccatgatcagaatcgcgcggcgatccaaatcgacgcgagagataatgcgcacgcctgccgcagcaatcgtaccaaacatcacaatcgttgcgccgccaagcacaggttcaggaatcaactgtacaaagcttgctacgccagggaacaagccaagtagtaccaacatgcccgcgataaaataacccacataacggctggcaacgcctgtcagcaggatcacgccgttgttttggctaaaggtggagtttggaaagctgttaaataccgcggctaatgcggagttgaggccatcagccaatacgccacctttaatgcgcttcatgtacacagggcctttgactggctcaccagagacttcggaggtcgccgtgatatcaccaatcgcttctagtgcggtgatcaggaaaatcagaaccagaggtataaacagcgaccagtcaaagcccaaaccgtactgcatcggaataggcagagcgatgaactgggtttccgccaagttgtcggtattgaccatgcccatcaggtacgccatcacataacctaccagcatcgcaatcacaatcgaagccactcgtacgtaagggttgtgcgctcggttcagcagcacaatgatcgccaatacggtgccagctagcgcaagcttatcgaggctaccaaagctgccgtcagccatagcggcataaccaccacccatcgaaatcaatccgacttgtaccagcgttaggccaatcaaggtcaccacaatcccagagactaatggcgtgataatgcgctgggcaaattgcagcacgcgggacagtaaaatttcagcgcttgaggcgaccaaaatcgtgccaaaaatcgcggccatcatggtctctatatctgcaccgcctgctttgagcgcaagtccagcaccaataatggggcctaaaaagttaaagctggtgccttgaatggaaagcaaacctgagccaattgggccaaaggtacggatttgaatgaaggatgacaaacccgaagcaaacagtgacatgctgatgatggtgttggtttgatcggcaggtacaccaagggattggcaaatgatcagcgatggggtgatcacggcgacaaacatcgccagcagatgttgcaaggctgcgaagagagtttgaggcaaagggggacgatcattgagttgatagaccagatctgccttacgtgaagtcggttgtgtcatagcgattttcctgatggtcaataacaccttgcgcacgctgaatgggtggttaaggtggagcagaagccgcttctgtgattgctgttatccccttcctatttgaagctgcagcggtgttggctccgttcgttcaccccaatcacatagtttgtctatgctcatggggatgaactcacttgccgcctacctgcaactccaagtagtttgggtataatcagactctgctctgggtagagaggtaaacgtttgcgcttaccggaaaatggcggcgattatagaggttttactcaggaaagcaaacgtttgcttgtggggttttagaccgaattgatgaggatcaaaaactaagctttggcgtaaatatcgcgctcgcctaaccagcggtcgatgatggcttgtgcattctgtgggtagcgttcatggatatgtcgcgcgatgcgttgcacttgcggaaccagttgctgatcgcgtaccagatcagcaattttgaaatcggctaagccggtttgtttggtgcctaatagctctccggggccgcgaatttccaagtcgcgctgcgcgatgacaaatccatcgttgctttcacgcaaaacgcccaaacgcttttgcgcggttttggagagtggtgcatgaaacagcagcacacaatggctggctacggtaccacgcccaacacggccgcgtagctggtgaagttgagctagccccaaacgttcggggttttcaatgatcatcaagctggcattaggcacatccacgcccacttcaatcactgtggtggcgacgagcagatgcagctcattgtttttaaacgcctgcattaccgcttgtttttcggcgggtttcatccggccatgcactaagccgattttgacttcgggcagtttacgttgcagttcctcggccgtttctgcggccgcttgcgcttccagcacttcggattcatcaatcaaagtacacacccaatacgcttgcttgccttcgttgaggcaggcgtggcgaatgcgctcgacaatctcatcgcgtttggtatccggaatcgctacggtttgaatcggagtacgcccggggggtaactcatcaatcactgaggtttccaaatcggcataagccgtcatcgccaaagtacgcgggatcggagtagcagtcataatgagctgatgcgggtacgcgccttgttttgcgcctttctcgcgcagctctaaacgctgatgtaccccgaagcgatgctgctcatcaataatgaccaaggcaagatggtcaaacgacacttgctcttgaaacagagcatgggtgccaaccaccattttcacttcgccactggcgatgcgtgccagctccgtttcccgcgctttgcctttgagcttacccgcgagccagccgacttgaatgcccatcggctctagccactgcgcaaaattgagcgcgtgctgctcggccagtagctcggtaggagccatcaaggctacttgatagccatgctcaatcgcccgcactgccgcaagcgctgcgactaaggttttgcctgagccgacatcgccttgcactaagcgcatcattgggtgcggcttggctaaatcggcttcgatttcggcaaccacgcgctgctgcgccttagtcggtgaaaagggaagctgtgctaagagttgttgtttgagttggtggacgggtgccagtggcaaggccacatcttgctggccttgactgcgaatcgcgagcatagagagattttgcgccagcagctcttccatgatcagccgaatttgcgccggatgtcgcccttgttcaaacaggcgcaaatcgatatccgccgatgggcgatgaatgatcttcagcgcttgggctaaggtcatctgctgatcgtaaagtccggatggcagtaactcctgcaccgcagatttttccagtagcaccaacgcttggtcagtcaaattacgtagggtgagttggcgcagtccttcagtggttgggtaaaccggagtcaggtttggctcaacatcgggcgtttgtgcaggggtaaagaatttgtagtcaggatggatgatctctaagccttgattaccgcgtttgatttccccataggcatgcacaaatttgccttccgcaaagttgtttttcatcgccgcggtgaagttaaaaaaacgcagtgtcagtgtaccgttgccatcactgattttcacggtgagcattttgcgtttgccaaacagggtatccactgccatcactttgccttgtaccgcggcccataaaccgtggtgcagttgcactatcggataaacgcgagtgcgatcttcataacgcagtggaagatgaaacagcagatcctgcaccgtgtgcaaaccgactttctccagtttttcggcgactttggccccgacaccggagagttcacaaagaggaacggctgaaaggagttgtgacatgcgcgtttgatctaaccatttgacttaatggctattcaaacatcgagctgtgtttttgtacaggaaaaattgcccaagatagggggtgaaacgcaggtttcaccctcgctggtgttgttcagttcttacggcggcgcactttaagcgcgtggggcatggtgcgaattttgcgcatgatgccagctaaatgcacccgatctttggtggtgagcagaacggtgactgtgtacaagcgaccatcgcgctcttccgttgacaggccatgaatattcgagcccgttttggagatcacattggtcagttcagccaatgcaccttggcggttgtgcatatccactttcagctcagtaatgaactcttgatcgtaatctttagtccattccaccgccatgtacttgtctggctctttttgatagccgcgtacgtttggacaggtttcacggtgtaccactaagccacgtcccggtgaaacgtgagcgatgatgtgatcgtcaggaatggggtgacaacagttggcaaaggtgagcagaatgccttctgcgccgcggatcggcagtttatttttattgccgccggatttgctaggctcggtcagttcatcagcattgccaagtaggcggcgtgcaatcacgatactcatcaactcacccaaaccaatcgcggccagtaaatcatccatcgaggcgatttttagatcgctcaagactttgctgatgttctctggggcaatttcgttaaccgagtgttcgccaagcgcatggttaagcaggcgacgaccgagagtaattgagtcttcgcgacgcatcgtcttcagcacttggcggattttggtacgcgcgcgcgaagtcaccacatagttgagccatgctgcattcggacgtgcgcccggcgcgctgatgatctccaccgtctggccacttttcagcgattggctgagcgggtatggcgtgcgatcgactcgcgcgccgacgcaggtattaccgatgtcggtatgtaccgcgtaagcaaaatcgacggcagttgcgcccattggcagctcaacgatacggcctttgggagtgaatacgtaaatctcatctgggaacagatcggatttgacgttttcgataaattcaaaggagttaccggcactttgctgtaactcgagcaagctttgcatccagcgctgggctttaatctgcgcggtagtgccacctcgttcactattggctttgtacgaccaatgggctgccacccctttatccgccatctgatccatatcttcggtacggatctgcacttcaactggaacgccgtgggggccaaccatggaagtgtgcagcgattgatagccgttggctttcgggacggcaatgtaatctttcatccgcgctgggcgcggcttgtacaagctatgcacctgacccaacacgcgatagcaggtatctgcggtatccaccacaatccgaaacgcgtaaatatccataatggtgtgaaagcgctgctctttggttttcatcttgttgtagatggagaacaggtttttctcacgacccaccacgcgagccggcagccccacttcttgtaagcggccttcgatttcactgtggatgcgttggatcatctctttgcggttaccgcgcgcggctttcaccacctctttaaggacgcgataacgattcgggtagagcgcttcaaagcctaactcttcgagttcggttttgatgttatggatacccaaacgatgggcgaggggagcataaatttctaaggtttcacgggcaatgcggcgttttttgtccggacgcagtgcaccgagggtgcgcatgttgtgcgtgcggtcggccagtttgattaggataacccgaatatcctgcaccatggccagcaccattttgcgaaagttttccgcctgcgcctctttgcgatcgcgaaatttgagcttatcgagcttagacaccccgtccaccaactcggcgactgagctgccaaaatgggcatctaagtcttctttggtgacatcacaatcttcaatcacatcatgcagcagtgccgcttgtagcgtttctaggtcgagacgcatctcggcgagaattcgcgcgacggcaacagggtgaatgatataaggttcgccgcttgagcgggtttgcccttcatgggcatctctggctaccacataagattggcgcagagcctcaatttgaggctctgtgaggtattcttgggcaacgtcttttagactatcgaatagatacaaatttcaggcccggcgggttaaatcgctacgattaacggttgtgcatgatgctgctaactgcagccagctctgccgcttcttgttcttgctgctcttgacgctcacgcgcatccagcacatctttcgtgatcagcccttcttcgatttcgcgcagagcgataaccgttggcttatcgttctcttccggcaccaatgcatctttaccgccagattgcatttgacgagcgcggcgagccgcaaccagaactaagtcgaaacggttgccaattttttcaacagcgtcttgaactgttacgcgtgccatgagaactccaaaatttagttaactgataagttgaatgacgagaaagtatacaggctaaccggttgagattctagcaacgggatagactgataacccaagctggctgtttattcagccaacagagcagacaacatagcgctatatttagcagcttgcttgtcttgcttcaatctttctgcacgaatgatggctttgaaatccattaacgcgacatcaaaatcatcattaatgatgacgtaatcatattcgctgtaatgcgaaatctcagatttagcctcacccatgcgtttagcgatcaccgcatcgctgtcttggccgcgcgtgtttaagcggcgttccagctcttctttcgaaggcggcaggataaagatgcttttcgcttctggcatttggctacggatttgacgcgcaccttgccagtcgatatcgagaaacacatcaatccctttgttgagtgtgttttcaatccacacccgagaagtgccgtaatagttgccaaacacttctgcgtattcgaggaattcccctttgccgataagctcaatgaaatgttctttctcgacaaaatggtaatgaacgccatcttgttcgccggggcgcataccacgcgtggtatgtgagaccgagactttcattgcataggttgggttttgctccaatagggcggcaattaagcttgatttgcctgcgccactgggtgcagaaacgatataaagagtacctttgcccatcgattcggttccacttaggttgggattgtgtctttgccttaaccggcaatgatttaaagatagcactgactggatccagaatggatgatttttcagccagaaaaatggaggcgaagagtagcacgatctgcaagatcttctcaagcgttgcgatggcttgtcggttaaactctccgcgcaaaaaggatgatcatttcggaatgatgacgccatcgtttgctcaaaaaatacccttgcgccggataacgtttgggatataatcgccgcccttgtgagttggctgttggtcaaccatgtaaaatttgagccggaagcgtgcttccaatttgggttccctcgcccccaaaccaaactaaaaaggtacagtatgaatcactttacccctgcgcagcagcgcaaagcccttggctatcttgttttgtttcacctcgtgatcattgcgtcgagcaattatctggtgcaaatcccgtttaccattttcggtttccacactacgtggggcgcattcacttttccgtttatctttttagcgaccgatctcaccgtacgtatttttggtgcaggattggcgcgtaagatcatttttctggtgatgctccctgcattggcggtctcttacttgctttcggtggtgttttttgaaggccaataccaaggtttagcgccgctgagtgaattcaatctgtttgtcgcgcggattgcgatcgccagttttatggcatatctgcttgggcagatcatggatgtgcatgtgttcaaccgcctacgtcaaatgaagcagtggtgggtggcgccaacctgttcgacgctgtttggtaatgcactcgataccatcgctttcttctcgattgctttctaccagagcagcgatccgtttatggctgagcattggacggaaatcgctttagtcgattacaccttcaagctcatcattagcttaggtttgtttgtgcctatgtacggcgtcttgcttaattacctgatcaaaaagctgactgcggtgaaccccaattttgcgatggcgagtgccaaagcctaattaaaccaagcgcgacacggtcgccgcggcgaggaaaaacaaagcccgagagaagtctcgggcttttcacatttaggattgagtagtcagtattaacttagtggctgtgtgccgcgccagcaccttttggatagcggatagattccaccatatcctgcacatcttgtggtacttcagcggtgaatttgttaaccacaatcgccaccacaaagttcaagcacataccgagtgtaccaatgccctctgggctgataccgaaccaccagttggcgggaacgctcgcggctgggttaatgaacttgaagtagatgatgtaagctgcagtaaaggtgatccctgccaacatacctatgatcgccccttctttgttcatcttcttatagaagatgccaaggatgatcgctgggaagaaggaggctgcagccagaccgaaggcgaaggccaccacctgagcgacgaatcccggaggattgatgcccagataacccgcgccaacgatggcgagtgcggcggcaatccgcgcggcgagcaactcctgcttatcggtcatatcgggtttaaaccctttcttcaacaagtcatgagaaatcgcggttgagataaccagtagcagacccgctgcggtagagagtgcggcggcaaggccacctgctgccagtagagccacaacccagttcggcagtttggcgatttcaggtgaagccagaacgatgatgtcgttgttgatggtcatctcgttacgcgcatcgcctgagtagaacatacgtccatcgccgtttttatcttcccatttgacaaggcccgtgctttcccagttgcgataccaagtcggtgcttcagcagccgtcacaccttgcatgtctggaccgttgatggtgtcaatcatgttgacgcgagcaaaggctgctactgcaggtgcagtggtgtacaagaatgcgataaacactaacgcccaaccagcagagacacgtgcatctgacactttaggtacagtgaagaagcggataataacgtgaggtagacctgctgtacccaccatcaatgctgcgcagataaagaagacgtcaaccatactctttgagccatccgtataggcggtaaagcccagttccacggcgaggccatctaacttattgaggagatagtcatcggttcctgtcagggttgaaccaaaaccaatttgtggaatggggttccctgtcatcatcagtgaagtaaagatcgcaggcaccaagaaggcgaagatcagtacacagtattgtgcgacttgggtataggtgatgcccttcatgccgcccattaccgcgtagaagaaaacgatcgccataccgatcacgataccgacgttgatgtccacttcaaggaagcgcgcaaacaccacgccgacaccgcgcatttgtcccgccacataagtgaaggaaataaaaatggcacagaacacggcgaccatacgcgcggttctggagtagtaacgatctccgataaaatccggcacggtaaatttaccgaatttacgtaggtaaggagcaaggcaaagtgcaagcagcacataaccgcccgtccaacccattaggtaaacggtgccgtcatagccgataaaagagatgatgcctgccatcgagatgaaggaagccgctgacatccagtcggcagcggtagccatgccgttggcgacagggtgtacaccaccgcccgcaacatagaattcactggtggatcccgctcgcgcccaaatcgcaataccgatatatagcgcaaaagtgatgccgaccaaaataaacgtccaagtttgaatatccatgctcagccccttagtcttcttgtacgttatatttcttgtcgagcgcattcatgcgcgcaacatagacaaagatcagggcaacaaaggtgtagatcgaaccttgttgcgcgaaccaaaagccgagtttgaacccagcaaattcaatcgtattcagtgcatcgacaaacaaaatgccggcgccgaatgagactaaaaaccacactgcaagcagtgagcccatgatccccaagttttccttccagtaggcttgagcatgttcagatgatttgaacgccatggccttctccttccttttcgttatcccgttagaggtgttaacacaatgttacgcatcttaggttagcagcctaatagcaagggatctgtgcaactttagtcgggggatttaggccaaaaaacagcgttaaagcgaagggttattcgacggcagctataaaaatgagatgttaatctgatgttaatgtagccaaaagtataacgacgacgagtggcgtaatggcttttttgtcgagcaaagctcgctaaagcgtgatttgtttacataaacttttcttagtgatgtcatgaattcgtgcacaataggcgggcaaacttattgataaacagggcaatccgttaacgacatcaagtcgttaatcgcagactgggaggtagagtggacgccgttacgattaacagtttttttatgataggtgccttattgataggcatcagcgtattacttagccctgtctcctcgaaattggggatcccgattttattggtgtttctcgcggttggtatgttggcgggagaagatggcattggacagattgcctttgataattatcccgtagcctatttagtcagtaacctcgctctagcgattatcttgctcgatggcgggatgcgcactcgagtggcgagttttcgcgtcgcattctggccctcggtctctctcgcgaccttaggtgttgctgtgaccaccttgcttactggtttgctcgcgatgtggctattcaatctgagcctgttgcaaggtgtcttggtcggtgcgattgtcggttcgaccgatgcggcggcggtattttctctgctcaaagggcgcagcctcaatgaacgggttggcgcaaccttggaaattgagtcgggaaccaacgacccgatggcggtgtttttgaccgttaccttgatcgcagtgcttggcagcgccgaaaccaatttaagcgcagggtttttattgctcagttttatccagcagtttggtgtcggagcgctgcttggcttggcgggtggctggattttatggtggctaatcaatcgcaaccaattaccggaaggcttgtactcgattctggcggtgagtggcggtttgatgattttcgccttatctaacgcgttaggtggcagcggaattttgtcgatttatttgacggggttattgctcggcaatcgtcctacgcgcagtcgtcacgcaatccttaacgtactcgatggcatgacgtggctggcgcaaattggcatgttcttagtgctcggtttgttagtcacaccatcggaattgatggagattgcacttcccggtttagcgttggcggtggggatgatcctctttgcgcgccccattgcggtatggattggccttgcgccgtttaaaagttttaccgcacgtgagaaatggtttgtctcttgggttgggctgcgtggcgccgtgccgatcatccttgcagtcttcccaatgatggcgggtttgcccaacgctcagctttacttcaacctcgcgtttttcgtggttatggtgtcgttggtggtgcagggtggaacgctgaccaaagccatgtcgctggcgaaagtggaactgcccccaaaaccggagccgatttcgcgcacgggcgtggaaatttatccgaccagcgagtgggagttgtttatctataaactcaaagccgacaaatggtgtatcggtgagccactgcgcaatctgtttatgccggaaggtacccggattgcggcggtgtttcgcgataatcaactgctgcacccatcggggagtaccgaattatgcgaaggcgataccttgtgtgtgatggcgcaggagcgcgatctggaatcgctcagtcgtctattcagcgaagcaccagaaaaagcttctcttgcgcgcttctttggggacttcttcctcgatattgaagcgaaattgcaagatgtggctttgttgtatggtctggacttaggtgagcttgaggctgacgctaagcttaaagatctggtgttagaacatttgggcgaaacaccagtgctcggcgattacttcgaatggcatggtttgcaatgggtggtcgccgatgtggtggattggaaagtgaccaaaatcggtctgcgcttaccgcccgaagaagagctacaagaaggcgcggagtaacgatcgtttgcgccttgatattgcggtgttgttcaacgccgaccggcaatggcaaggcgtttgggtatagtgcgagtaagcagaaatgagcgagtggatcactcgctcatttcttttagcaagatcactgcttgagtgcggtttttcacgccaagtttgcggaaaatggccgtcatatgcgcttttatggtggcttccgacacattcaattcataagcaatctgcttgttgagcaggccatcagacagcatgccaagtaccttgtattgctgcggagtcagcgcggccactttttccgctaggtcattaccgacaaagccatcaaccagtaaatgtgcggggaaataaggctcgccgttgagcacttgattgagcgcggcaatcaggctgcgcatatcgctcgattttggaataaagccaaacgcgccgtgacttttcacctgcgataccacgctaggttcttcactagcggaaatgactactatcggtaaatctgggtattcggaacgcaagtgaatcaaaccggacatgccattggcgccgggcattttcaaatcaagcaacagcaggtcgggctctgattctttattgagtagggtgagcaaagcatccagcgagtccgcttccagcaaattcgcaccgctgatcgccatgtgcaccgattgaaacagcgcgttacgaaacaggggatggtcatcagcaatgatgatggtgtaggtcgagtccatgacgtcacaacaggtttaccaaacagttataggaattattgttctgtttagcgcagtgaacaatctttacccgttaaaagtctgaactgtatccctttttaaatgcatgagtttgaatagcgaacacgatttcggtggcgtcgccccaccgcagtgcgaatggggcgacaacttataaaccttgttgtgtgagatggtcgagaaacggttgctcggccataaaaccgataatacgagcattcggtaccggctcgccttgcgcgttccaaaactcaatggttggcaaaccgagcacattcagcgccttgagtaactcaatatcctgcggctgatttttagtgacatcggcttgcagcagtacaaagccgctgagcttgttttccacttgcttggcgtgaaaggtgtatttctcaaactctttacaggccacgcaccaatccgcgtagaaatcgagcatcacagatttgccttgtgctttagcctctgccagtgcgctttgcagctcgctcaggttagcgatgcgagtaaattggatctgtttgacctgctgagcggtttgagtcggtgccaaccagtgattaagcaggggctgcgcagaagccagcagtcctaaaatcgcgactatcccaattaagctctgtttccaaccaccaaacggcaggctgtttttgacatggtacagccagccaaacgccgctaaaccgagagccgaccacagcacgctggaccaaaactcaggcacaatgcgctcaagcaggaaaatcggcgccgcgagcagtacaaaaccgaacagggttttcactcgctccatccagttgcccgctttaggcagcaatttattgccaaacacggccaccaaaatcagcggaatacccatgccgatggcgagcgcgtacagggcgaccgcgcccgtgagcagatcgccactttgcgctacataaagcagggcgccagaaagtggcgcagtggtacaaggcgagcagaccaagcctgagatggcacccatggcaaacacaccgggtaggctgccgccttgctgagcgttactcaatgaattcagccaagtctgcaccccgcttggtaactgcaggctgtacaaaccaaacatggaaagggcgagcgccacaaacagcacgcttaaacccatcagcacataagggtgttgtagtgcggcttgaaattgcaatccagccgaagcgaccactaacccaagcagggtgtaagtgagcgccatgccttgcacgtaaatcacgctgagcagtaacgcgcggcgttgggtgagctgggcaccgccaagtacgatactggttaaaatcggatacatgggcagcacgcaaggagtgaaagccagaccaaccccaagcgctaaaaacagcagtggcgtccaccaattttgcgccagtttgttggccagtgaatcttgggcagacgtgggggcgttatcggtttgtggcagtgttgtttgtgttgatgtgttggtcttaggctcgataacgcggtttgattctgcgttaaatggcgtaatgtcgatcactcgagtttctggtggatagcagaaacctgctttggcgcagccttgatactgcacgatgactttggctccgctttgataagccaccaaaggcagcggaacagataaaggtgttgtgtagattttcacatcaccaaaaaactcatcgtgataaggctcaccttcggtcaatgagtactcaccgatctcaagattttcaccactgatgctgatcctgtcttgatagaggtaatatccctctttgacttgccaatcgataaacaaggttgagccttgctggaacgcattaaacggaaacgcttcatcgaccggaacaaaacggttttgtgtcggagcaaagcttgcagtgcctgtgttattgccagcgttattaccaaagatcgcccaagcgggttgggtaagcagggcgaacagcagtgaaaaacagagtatcagtgtgcgcatgagtcaaatcgtgattaatcatttaccggtgatagtaacccaatcagacccgagaagggcgcaataagtttcaataagatgaacatcaacaagggaagccagtggcttcccttgtcattaggtgttgttgattcgaggatgcgaaagctttccccttacttaaggatgtcgtttttcaaagacggcgactgaccatgcaggaacgctcagtcgctggttaacaacgctcgcggctacgccattataagcgatggaacgattacccagatccgcttgaatggcatgcaactgataatcggtggcatcaaagtgggcaaactcggtgagcggtgttgggctggcgttgagtaccaccaccaagcctgatcgcgcagcatcgagggaagcatcatgcagatcgccttggttatcaatgctcatcactatgacgcccggaatttgctcactgcctgtgttgtggaaatggacgcgtttgatgatctcactgcctttgcctaacgtgagtagggatgacgagcgacgcagttgcaccaattcattgaaataatcattcatggtggtaatgtcgacggcttgtggctcggcattggctccggcttgtgcaatcacggtttcaatgatcgaccagttgctgccgtccttgtcttgacgtggcaggcccacattccagttattgctggttttgctaaaatcaacgcggttataccagtcaccagagtcgtaagagtcacgctgcatggatttagaacgcagtaactcgcttcccatgtgtacaaaaggcacaccttggcctaataccgccgtcgctaagctgaccgcttgcatgcgcactcgagtgtgtagtggcagcgcatagtcaattttgtactgctggttatcccacaaggtttggttatcgtgcttagaaacatagttttggatctcccatgcatcattggcataacctgccgcttggccgttgtagtcgagttctgagcccttgatggtgttgcctgtttggtcaataaaggtgaaggcttttaaattcccagccataccaaggcgagttaaatctgccaagtgcagtgcttgagctcgcgtgttgttgctcagatcatttttttgcacataaataccgttaccccagccttggttagcgcgtaggctcgcttcgccatcaaatgggccgccaccgcgcacggcatcacgcagacgatctgaaaacgagccaatgcccgttccggccaaattgggttgggttgcctgtttgaattggcgatcattcgccacttcgccaaagttccaaccttcgccgtagaagtaaacatcaggattgatttgcttggccgccgttaaggtttgctcaatttgcgccagtgggtgatgtcccatcaaatcccagcggaaggcatcgattttgtactctttaacccaagtacgaatcgaatcatcaatcaacttagcaaacatgcgattttccggtgcggtattcgagcagcaagtagaattctcgacctgaccactccactcattcaagcgttggtagtaccaagggacgatgcgatccagtaccgatttatccgaaacccccgcttcgttggtgtggttgtaaaccacatccatcaccacattcatcccaatctcttgtttgaccgcttgcaccatctcacgaaattctttgatgcgggtaacgccgtcaggttgagtggcatacgagccttcaggcacggtgtagtggaacggatcatagccccagttgaagctatccacatcacgcagaaaaccatttaaacgctgcacgagaggctgctctttcgagtctttggcttttaacgtggtaaagacgctttgcagtgtgtcattaccagtgcagtaagccgctaagtcactgtcgtttttgagtacgggtttgagatcacacaaacggctaaatggctgatccaaattgaccacttgctctgggtcttcattgatggtggcaatatcaaacacgggcagcaaatgcagatgggtcacaccagaacgagctagctgttttaaatgttgtacgggctgactctcttgctcgctaaaggcggcaaatttaccgcggtgcgccgaagtgacggtggtgtcgtgggcagaaaaatcacggacgtgagcttcatacaaaataaaatcggcacgctcgtgttgtggatgtggcgcagctaacgtatcccagccctcaggtttgagatcggcatgattgagatccactacctgactgtagagtgaattgatggccaaactgtgcgagtaagggtctgtcacttgataggtttcaatctggtcagtcgcagggtgatagacggtgatttgtagtaatcgccatgcgccagtgctgtgttgacggcactccaactgcctgactgggtatcaaagctcatcgcaatcggtgttttggcttgtttatccgtcccgtaagggatcagcgataccgcttgcgctgtcggagcccataagcggaaagtggtgctgccatcaggattgatcagtgcgccatattgcaaagtgctcgcgctatccgcatacagcgcatccaaggcactggcgggctgtacttcggttgctaaaaggacgcctgtggtatcactggcaaccagtaacagttggccttgcaataaggttttgagatctaaccctgcggcttggaaatcaaactcaaagccacgaaagcctgaggtcaaatgcggtttttgcgcttgccattcggtgccgcttgggcgctgagaggtaatcgtatggtcggcattgagtacggttttactggcactgtcaaaacggagttgaccttgtcgggagtaatacagagtggctgatgtcgcttccagattgcccaccagtaaggtcgacgcatccgcaaaaatcgcgcttgcaccactcagttcaacctgattttgtggccgttttgccaaaggctggtagtaaattttgtcggtgcctttgaacacaaagccgatagggccaatcgctcccgttttggtgaaatctagtttcaaattggcggtttgatagtcgccgttggttttattgttggggataacattgatgcagttatcgcggccattaatcggtaaatcccaataagggccataggttttactgtatccgctcggcgcgatgcccggccaagctgaattgctggccgcatagttttggcattcaccttcattccacacatgcagggtgaagaagctttcatcgccatcttgcgtattgagatacaggcgcgcggtattggccggcagtgcattacgggggattaactctggatagactgccgcaacgccttgctgggtgtaaaccgcattacccgcacctaactgagttaaatcgactttggcatcgtaatcgcccagtggtttttgcccatcaatccgtggaataaagttaatgcactgagtggactcattcgcatgatagggcaactcccaataggcgcctaactcatcatcaatcccggtgggcaatagacccttggcccaatcgttcgcgtcagggttattgcccgcataggccgcgcactgctcattgttccaaacataaagagaagctttgctgtaaggcgagctgtcaccactgcgctgggcggtggtcgcttggtaatagactttcaccaactgttgaggggtgactgggccttgggtgttgttatctggattagtgtttgactcattgcagccgagcagcacggtactggccaacatcggcagcagcacgcgattcacgcgtgagagattgaaagtaggattattcacgttctcgttccttagaattatagaggttgttgttcaacactatgaataggctaaggaaaatgctgggctacggagtgtgagacaactcaataaagatcttttcgatgaagaaaaatcctcaagcagggtagaacatcacgaatggtgggaggaggagccgtgatttagagcacggattgtagggtgagatgacgtgctatacagagcaaagccctactgagtgcgccagttagcctcgctttgcctgatggtgatgacaaggtagggtttgaaacggatcgcatttctcaagaagatgattttcgagagaaataaagctcctccaatcaggagaatggcgattggcagcgacaaaaaagggagccgcagctcccatgattttgcactttattcttagataaacagactgccaaagaggaagccaaaggcaacggcgctggcgatggtgaccacacctggaataaagaatgggtggttaaatacatagctaccaatacgcgttgaacctgtgtcatccatttctaccgcggccaacaaggttgggtaggttggcagtacgaacagggcgctcaccgcagcaaaagaggctactgcggtcagaggtgctacaccaatcgccagtgctgcaggcatcagcgcaactgtggttgcaccttgtgagtaaagcagcatagaagcaaagaacagcactagtgccagcatccatgggtagtcagccagcagagtaccagccacttctttgatgccatcgacgtgcgcgttgacaaacgttgaaccaagccaagccacacccagcacacagacacaggctgtcatacctgagcggaaggttgaagcggctggaatttgtgctgcgtcaatcttagtcagtagcacaataccggctgcagctgcgagcatgaaggtcatgatcgcttcgttacggccaagcgctgggttttcgattagaccaatcgagtttgaaatcgccgccgcgtagcacaccaccagaatgatcgcggtgaggaagatgtaagtcgcggttttcgcggttggcagaatttcacgcttctgagtacccgcaagcttgatcagaccttgtgccagacgctcttgataaatcggatcatctttcagctcgctgcccataaagttggccacaaacgcaccgaccatacaggcggcgaaggtagttgggatacagatcgccagcagtgttaagtaatccacaccaaacggcaccaacatcgcggcaaaggcaacgacggccgctgaaatcggtgaagcggtgatcgcgatttgtgaggcaacaacagcaatcgagagtggacgtgaaggacgcacgccttgaccttttgccacttcggcaatcacaggcaaagtggaaaatgcggtgtggcctgtacctgccatcagtgtcatcaggaaagtgacaatcggagcgtagaaggtgattctttccggatgtttacgtaggaagttttcggccagttggaccagccaatccataccgccagccacttgcattgcggcaattgcggtgatgaccgacatgatgatcaagatgacatcgaccggaataaaggcttgtttagtcggtacgccaaggattaatgacaaggcgatcacaccagcaccaccggccaaaccaatgccgataccgccaatccgtgcgcctatgaagatgaagaggagaacaatagccagttcgacccaaatcataatgattacctcatttaaagatgaaaaaattatctcaacactcaccataacgagcgttcaaataatgctttcaccgcattgagtttgatgagaaaagcccccaacaaagggggcttaaaccgaacgattattcgtaacgttttgctttgtactgaggatgcatcaggttctcaaccgagaagatgtcatcgagctgctcttcagttagcaagccgcgctcaagtaccacttcgcgtacgctcttaccggtttcggcacagatcttaccgacaatgtcaccctcatggtggccaatgtatgggtttaagtaagtcacgataccgatagagttaaacacgaagttttcacagatttctttgttgactgtgatgccatcaatgcacttgtcgcgtaggttgacacaggcgttagtcagcagagagatagactcaaacatcgcttgagcaatcacaggctccatgacgttcaactgcagttgacccgcttctgcggcgaatgtaatggtgttgtcgttaccgaatactttaaagcaaacttggttcaccacttctgggattactgggtttactttcgctggcatgatggacgaacccgcttgcagttcaggcaagttgatttcattcagacctgcacgtggaccagaagagagcagacgtagatcgttacagatcttagagagcttcatcgctagacgtttcaacgcgccgtgagtcatcacgtaagcaccacagtcagaggtggcttcaatcagatcttctgctggaacggtttctaaacctgtcacttgcgccagatatttcacggccagctcttggtaacccggagcggcgttcaggccagtaccgatcgcggttgcgcccaagttcacttccaaaagcagttttgaagtgtattgcagcgcgcggatctcttcattcagcgtcacagcccatgcgtggaattcttgacctacggtcataggtacagcgtcttgcaactgagtacgacccattttcaggatgtttttgtactcagccgctttaagttcgaatgagccttttaggtattcaatcgcatcaatcactttcaggatgctgttgtaaaccgcgatgcggaaacccgttgggtatgcacagttggttgattggctcttgtttacgtggtcattggggttgatgaactcgtattgacctttttgtttgcccatcagctcgagtgcaacgttagcaatcacttcgttggtgttcatgttcactgacgtgcccgcaccaccttggaatacatctgacgggaattgatccatgcacttacctgtttcaagaatcaaatcacacgcttgaaggatgtagttcgccacatctttaggaatcacgcccagctctttgtttgccagagtggccgcttttttggtcatgatcatgccgcgtacaaattcaggcacgtcagagatcgtaacgttagagatgttgaagttttcgacagcgcgaagggtatgaataccgtagtaagcatcagcaggaacgtgacgttgacctaacagatcttcttcaacgcgggtagccggagtcgctgttttaggcgcttcagatagggtagccataaggggatccttagataattattctggtaaaaaactaaattaatagccatttctgtaatttaagaatccattcgtcagagtttttggctggaaatccgtcctgacttacgaggcacataatactgtaaatgcatattaaaaatagtaactggatcaccttttaatacaatttgatggaaaatttgctgagagttttatctataactatataaagagagaaagcggtataaaaaggaacggatttatggtgaatcgtgccgattcagcaaggttgttgtcggaccaagatctacaaggatatgtcagccgcatactggatgtgattccgctgccgatcattatttctaaatcttctgtgctcggacaaggcgagcgtgagcatctgcattttaataaagcttttgtgaaagagctcgggtataccatggcgcagatcccaaatatcgagacttggtttgaaagggcttacccacaaattgactatcgacaggagatcattgcgcaatggcaaaagacggtcgatgaggcgcgggcgcaaggcgaagatgtcgcgcatatgcccgctttgatcatgtgtgctgatggggtgcagcgttggttttccgtctcagcgcaaatcgaaccgtcctgtcgtgacgatctgcatatcattacttttcgcaatattcatgactataaaatctctcttgcggaagccgagcgccaatcgcaaattgatccattgactcaactgaaaaatcgccgaggtttcttcacttggagtgagccgatagcacctgagacgctactggggttgataatttttgatatcgaccattttaagcaaatcaacgatacctacggtcatcctgctggagactatgtgctgcgccaaatcgccggattgttggagcaaaacttacctccactgtcttgctgtgtgcgttggggcggtgaagagtttttggtctgctttgaatgcgacgacatggcgaatgtgattgggctggccgaaaacatacgagactatgttgagagccataccttgatgtggcaaggacagcagattgctttgacgctcagtgctgggtgcaccatgggagcgatgatgagtcacaattgggacaatttgttacacactgctgatcaagcgctgctgtcggcgaaacgcttggggcgcaatcgggtgattgctgatcggtaaacaaaaagtgtttgttggcgtcggttttctctctgggtgacttgtcagccatctcggttgtggttaacgtgaccaaaaccaaggaggcattgtgttcccgatactactgtttttatttattgcagtccctgtgattgaaatcgcgctgtttattcaagtcggcggcgtgctcggtgtgtggccgaccatcgcccttgtgctgttaaccgcaattgttggtgcttcgctggtgcgtagccaaggtttacaaacgctgttgaccgtacaacagcgcctagcgcaaggccaactgcccgcacagcaaattttagaaggggtaatgttagccgtggcgggtgtgttgttactgaccccaggctttttcacggacatcctcggtatgctggtactgctgcctgcgccgcgtgcttatttcgcaaagcagttgatgagtcgtgtggtggtcggcaatatccacgccagtggagccggttttgagcagcccaacccttttcacgatcgtgcaaatccaaacggcacgacctatgaaggtgaatttgagcgcaaagacgatcaagaccagcaccgtttgaaataataccttaggtcagtcggttactttgatggtgtattagcgtgcgccatcaaaccccatttgacgccacgcttcaaaagcaataatcgctaccgcattggaaaggtttaggctgcgcgcttctggcatcatcgggattcgaatccgctgctcggcgggcaagctggcaatcagctcggcaggcaaaccgcgtgtttctggaccaaacagcagcacatcgccttgttgaaattgggcatccacatgatgttgtgtggttttcgtggtgcaagcaaacaagcggaaagagcctcgctcacgctgtaagtattcgataaacgcggcgtaatctttatggcgcgtcactcgagctaaatcatggtaatccaaaccggcgcggcgcacctttttctcttccagatcaaaacccagtggctcgatgagatgcaagttcgcgccacagttggcacacaaacgaatgatgttacccgtattgggtgcgatttcgggttcgtagagagcgatatcaaacataacggatggtcaatgaaataaagaaggggcgagtatagccccttctgatgatttacgcagcttgggtgagtgcgatggcgtagttttcactgaccgcttcccagttcaccacattccaccacgcatcaatgtactcagggcggcggttttggtagcgaatgtagtaagcgtgttcccacacatcaagggcaagaatcggctcgccacgcacggcaaccacatccatcaatgggttatcttggttgctggtggaagtaatgctcagttgaccttgttgcacgataagccagacaaaaccagagccaaaggtgttcacggccgcttgcgagaaggcttctttgaactgcgcaaaactgccaaattgacgttcgatctctgcggccaattcgccttgtggctcgccgccagcgttaggcttcatacagttccaatacacaatgtggttatagtagccaccaccgtggttacgcacggccgcgggtaaggtcgaaacgcgcgcgaaaatctcgctcagtggcctatcttcatgctcagtccccttgatggcagacagaaatttatcgtagtaagtgcggtggtgcttgctgtaatgcacctccatggtcttggtatcaatataaggttctaacgcatcgtaagcgtaaggtagatcgggaaatagatggggcatagtatcctccttggatgaatatcgcttggctatcagcaaggcggatagcaagggtattcttttatgttaatgataattaatatcattaacaacctggagattgtgaggatattgctgccccgagttactgcgttaagcgctcgccagaggtaaagtaaagcgaacttgtaagcctcctaagtgactgcggtttgcgctgatagtgccactgtgttggcgaatggcattttcggtgatggctaaaccaagccctgtgccaccgctgtgtcgatcccgcgctgtcgagacgcgatagaacgggcggaaaatatccgccaactcctcttcgggtacaccttcgccatcatcatcgacgctcacgatgagttgctggtcttgaatggtaaaggctacgtggatctgctgttgcccgtagtggatcgcgttacgcaccacgttttccaatgcactcatcagtaatttgggcgtgccgttgatggttcgctctgggatcgcgtcaaaagtcagcattttgtgcatctgttcagcttcaaattgcgcatctttgagcaactcttcccataaactactcagtggctgcacttcgcgcattaaatggctattgatttgcatgcgtgagagcgccagtaaatccccaatcatctgctctaaacgttgtgcttcggtatcgatccgttctaattcactgctactgccgagtttacgcattgccagcgcgttggccatgcgtagccgagttaagggggaacgcaattcgtgggagatgtcagaaagcagtctttgctgcccagaaaccatctgattgaccgcatccaccatctggttaaagctgcgtcccgcctgttgaaactccgctgtgccgcgttctaatttcgggtcatgcacaaattcgccccgcgcgacacgctgcgcggcttgagccagattttgcgccggtttactcaaggcccacgccagccacagtagcagcggggtgctcaccagcatgatcgccaacaagagttggaagggtttatcaaacagacgcagcaaaaacggcggtggttcatcccagcgcataccgacatacaacagcagatcttgtttggctaacgtaatgggcactgggcctgccaacatataacggccatacaggcgctgctgcggtttttgaaccgattcaatactggagcagaagttttgcatcgctttaaaacgaaaatcggtctgctttgagttggtgataatgttgctttccaaatcggtgataaaaaaacgcggctgaccatcgtgtttacggtgctgactgtctggcccttcgagctgaaacagaatggctcttaagtcgctttggttgcgaaattgctgttcaaagcgatctctgctctcgagcaaacgttgatgcgtttcgggtgataagtcacgcgatttacgcgggtcaagatgaggtagggtcaataccgcgaacagtaccaacagcatggtaaaccagaaaatcgcaaagatgcgcccatacaggttattcaatttcggtaacggtagacgcattactcctcctgaaccattaagtagccgcgaccgcgcaaggttttgatccgtgctttgccatctggccgctcaggcagttttttgcgcaggttagacacatgcatatcgatggctcgatcaaatgccgcaaggtgcttgccgagcacttcaatactcagcatctctttggtcaaggttgctccgggcgactgcacaaagtgagtgagcagggcaaattccgtagtcgtcagttccagcagttgtccttggcagtaggcttcctgttttcctgggtagacttgaatgtcctgacactcgatgacatcgctgtttttaggcgtgaggccgttttgcgtacggcgcaaaatcgcacgaatgcgcgccagcaactcgcgatcgctaaaaggtttgggcagataatcatccgctccgagctctaagccgatcacccgatcgatctcttcgcctttcgcggtcagcattaaaaccggcgttgcccatttttcgcgcagacgcttgagggtttccatgccattaagcttaggcatcatcacatcgagtaggatcaagtcgatctcatcgctgaccgcggctagtccggcttcaccgtcattggcttgtgaaatttcaaagccttcgtactgtaaaacctcggtcaatagactggtcaattcggtgtcatcatcgatcaaaaggatatgtgccatagctgcctcgtgtattgctttgttaccttcagtttaccgtgaaaaaagtgctgtggtcagtgagcaatctgctctttacgattctttacgctccctatacgtcacttgaccttgcaagtcgtaatctatgttcaagcgctgcagagcagcctaatcgataacgaaacgaaatgtagaggaacgaacgatgaaacttgccaaaaaaatgattttagccgcggctgtcctaccgctgactctgggaacgacggcggcgctggcttacggtggtcacggttgggataaagagggtgatggacattgtggcgaccgcggtgaacgtgggatctggaaacagcttgatttaaccgctgagcagcaagcccaactcaaagagatgcgtgaggctggacgtgaagagatgcgcgctaatcgcgggcaaagccatgatgcaatgaaagcattgcacgcgcaggagcgcgctctggtgctcgcggctgattttgaccaagcagccgctgagaatctggcaaaacagatggtagatcagcaagtgactcatcgcgtaaaaatgatggaaaaacgccaccaaatgatgagcattttgactgccgaacagaaagccaagttgcaaaccctgcaacaagagaaaatggcggaatgcatgcaagatggccaacatggcaaaggcaaaaaacacgctagtcaataatcgaacgactcacgactcttacttcaacaaggcggcctaagtgctgccttgtggttttggatttctcggttatctcctccttcttccgcttgaagcggcgcagtgttgactgggctcgttccacctgacacctgcaacgctcactcgtttgggtatatactcggtcttctgtctgacaacccaagaaaaagggaagcgtgatgaaaaaagaatacgctcgtttggtcaccatggccgcttggaccgcgacggcggtagcctcgctgctcttggtggtcaaggttgcagcgtggtgggtaacggggtcagtgagcttactggcgtctttaatcgactcagtactcgatatcgccgcctctgtggttaaccttatcgtattacgttttgcactacagcccgctgaccatgaacatgcgtttgggcatggtaaagcagaatcgctcgcggcactggcacaagccatgtttatttcgggctccgcgtgctttttgatcctcaacggtgtcgaccgcttcttccgaccccatgaattgaatgctcctgaattaggcatctatgtcagcgccatcgccatattggtgacttttggcttagtactgtttcagcgctatgtggtcagaaaaaccggcagccaagcgattgccgcagactcgctccattatcaatccgatctgctgatgaacgcggccatcatggttgcgctgggattaagttggtggggattgggtcaagcggatgccatttttgcgatcggtatcggtctctatatcttattcagcgcctttaaaatggtgcatgatgcggtgcagacgctgcttgaccgtaaattacccgatgaagagttggaacaaattcatgcgatctgcctcagtgtggctggcgtgattggtatgcatcaactgcgtacgcgtatgtccggcccggtgcgcttcattcagctccatttggaattagatgacaacatttcgttgctcgaagcacatcagatctcggatcgggtggaggataaattgcgtgaacattttgtgggggctgatgttttgatccaccaagacccgcattccgtggtgcttgaggccgagcagcaacaaaaatcgctccagtgaggcgacaaaaggcgtcagtttgactatcttttccccaagttaacaaaaaaacgccaaccctgacatgaatcaacacagggtgagcacaaaactgtaatactcttacataagtagaaaacttacagaatttagtgcaaataacagtagtattcctaatcgggaaaggtaacattacgcacagtttttgaatttttctgtctggttccttacaagccagacggcgtagaaattgatattcgattcgcaaagttcgagggtgagcatgattaaaaaaatcggtgttttgacgagtggtggcgatgccccaggtatgaatgcagctattcgcggcgtggtgcgtacagcacttggcgcaggtttagaagtgtttggtatttacgacggctaccaaggtctgtacgaagatcgtattaagcagctagaccgttcaagcgtgtctgacgtgatcaaccgtggcggtacttttttaggctctgcacgcttcccacaatttcgtgaagttgaagtgcgcgaaaaagcgattgaaaacctgaaaaagcacggcattgaagcgctggttgtgattggtggtgacggctcttacatgggcgccaaaaaactgaccgaaatgggtttcccttgtatcggtctgccaggcacgattgataacgatatcgcgggcaccgactacaccatcggttatttgactgccctgaacaccgttattgaagcgattgaccgtctgcgcgatacctcttcttcacaccaacgtatctctatcgtagaaatcatgggtcgtcactgtggtgacttgacgctgacctctgcgattgcgggtggctgtgaatacatcatcacaccggaaacgggtctgaatatggagcagctgatttccaatatcaaagatggtattgcgaaaggcaaaaagcacgcgatcattgcgctgactgagctgatgatggatgccaacaaactggccaaagagattgaatcggcgacaggccgtgaaactcgcgcaactgtattaggccatattcaacgtggtggtaaacctaccgcatttgaccgtgtactggcatcgcgcatgggtaactacgcggtgcatctattgatggaaggtcacggtggtcgttgtgtgggtatccagaaagagcaactggttcaccacgacatcattgatgcgattgaaaacatgaagcgtcctgtacgcactgacctgtacaaagtcgctgaagagctgttctaagttcgcagcactttgtattcagagacaaaaagaccgccaaggcggtcttttttatacgggtttgtttatatgcggattagagaatgatgtcgcgcacttgttggtctttacgctccagatagtgaattgagcgaatacgacgaatggtgcgacagcggccacggatcagcagtgtttctgttgttgcgatattgcctttgcgactgatgccatcaagcaaatcacctttggtgatgccggtggccgcgaaaatcacgttatcgctgcgtgccatgtcttccattttcagcactttaccggcttctacgcccatttgttgacagcgttcgagctcttttgccccccaaatgcgattatcttcgctatcgcctttgacttgatgacgcggcagtaaacggccttgcatgtcgccatccagcgcgcggatcaccgccgcagagactacgccttctggtgccccaccaatgcagtacatcatgtccacttcactatcgggcatacaggtcagaatcgatgcggcgacatcgccatccggcactgcaaaaacgcgtacgcccatctgttgcatttgcgcaatcacttggtcgtggcgcggtttggcaagcgtgatcaccaccaaatcggttaagggtttgccgagtgcttttgcgacatggtttaggttatctttgagcggcaaattgaggtcgatgcagccttttgcaccggggccaaccaccaacttttccatgtacatatcgggcgctttcaggaaactgcctttttcaccggctgcaagcacggctaaggcattggattgtcccatggcggtcatgcgagtaccttcgatagggtcgaccgcaatatcaaccgcatcgccccccagaccgacttgctcgccaatgtacagcataggcgcttcatcaatttcgccttcaccaatcacaatttcaccgctgatctccgtttggttgagcaggatgcgcatcacttctaccgcagcaccatcggcggcatttttatcgccacgtcctaaccatttatagcctgcgagtgcggcaccttcggtgacgcgggaaaaagccattgctaaatcgcgtttcatgtttgctttgctccaaacccaagagagaaattttgcgcggcattctaccacactcccaagtaaacgtttgccttttgcggcgattcgcctttgcctttgatcaaaaacgcgcaagataagtcgaggtttgctcgaaaatgccagctcggatcgggcttagcggctcgttaagttaagcttgggtcaaattgcgcggtttttttaaccgaatagcgaaaaagatcgaacttagggcgtgtttctgtgcacagggctgagtagaatgaactcaatcagtgaagtccacttcacctcaaccgaatcaacaagggtaaaacgtcatgtcttttgaagtattagaaaaactggaagcgaaaattcaaactgcagtcgacaccattgcactgctgcaaatggaagttgaagagctcaaagaagaaaagcaacagctgcaaaatgaagcgcaagagctgcgtgaagcgcgtgaagcacttgagcaacgtgcacagcaagttcagcaagagcatgcggcatggcaagagcgcattcgtagcctgctgggcaaaatggaagacgtggaataattttccttatgaaaacgccgacagtgatgtcggcgtttttgatcgaggctcggagttttcacttaagcttgtgggcgaacgcctaaggtgtggcataacgcgtaagtcatttcggcacgatttagggtgtagaagtggaaatccttcaccccttcacggcacagcacgcgcaccatatcaatggcttggcttgcacctaccaactggcgagtcactggatcgtcttctaatccttcaaactgcttcaccatccaattcggaactttgacgttgttttgcgcagcgaagcgcgacgcttgtttaaagttagaaaccggcagaatgccaggcacgatttctacgtcaatcccagcggccacacagcgatcgcgaaaacgcaggtagctttctacatcaaagaaaaactgcgtgatggcacgattcgcacctgcatcgactttacgttttaaattgagcaggtccgcttgcgcgcttttggcttcagggtgcacttcagggaaggcggccacggaaatatcaaaatcgtggcgtgatttgagcagcgtcactagatcggaggcgtacatctctggcttaccaccgccagccgggatatccccacgcagcgccacaatattctggatgccgttatgccagtagtcatcggcgatctggatcagttcatcacgagtggcatcgatacaagtcaggtgtggcgcggcaattaaaccggtttgatctttgatcgctttaatgatcgagtgagtacggtcacgctcaccagagtttgcaccataagtgaccgaaacaaatttcggttggagtgttttcagacggtgtaccgatccccaaagcgtttcttccatttgtggtgagctgggtggaaaaaactcaaacgaaacattgatgtcggaaagctccgcaatgttttggttcaatgcatcgatatggctagcgtgtgtgtatcccatcttgtactccctgtgaccgagtgtcactgcctgaatctgaattgacgtttagacgtctatatggctgtagaatgtcgtgaatgcgctttgatgtcaacctcgccattatgaagattactcatgttgatcgtgaagtcgattcacgctcgaaaatgtcattcagcgctatgtatggctcttggtgagagagatagaacatgatgctttctatacccaaaagtatagaggatgggagggaaagctcgccatttcgacgagctttgttttaaggggcagaacgagagatttagagtaggctcgcgagcagattcaaatccgactgaatcgcgccagcggtgacttcacgtccagcgccgggacctcggatcaccaatggattatcgcgataccatttgctctcgatggcaaagatgttgtcacacggcagtaagttagccagtggatgatcttgctcaagcgcttctacacccacgctggctttgccatttttctctagccttgcgacgtagcgcagcaccttgccttgcttctgcgcacgggcgaggcgttcggcgagctgctcgttgagcagtttgctgttatcgagaaaatcatccagtgatacagagcgcagctcggcaggtaccaatgattccactttgacattctgcggctcaatctcaaggccagattcacgcgccaagatcaccaatttacgcatgacatcagaaccgtcgagatcgcagcgcggatcgggctctgttaagccttgttgccatgctaaatccaccagttcactgaatggcaagctgccgtcgtattgctggaacagccatgagagtgtgccggagaaaatcccggataacgccatgatgtcatcgccgctttcacgtaggtcacgcaccgtgtggttaattggtaagcccgcgcctaccgtggcgttatacagccagtggcggccaattttgtgaaaggcatctttaacttgatagtaataattccccgcagcagagcctgccactttgttggcggaaatcaggtgcaaaccgtgttcggcaatatcgagatactgctcagctaactcttcgctggcggtgacatcaatcacgacggcttcatcgtacccttctaatgcgccgagttttttcagccagctttgctcttggttgggcagtgcttcatcttggaaatgcgtggccacttggtttggattaatgccttgctcattaaaccagtaggtttggctatcgactaccgcaaccaactcaaaattcatgccgtggcgttgttccaatttctctttttgttcggcaaacaacttgagccagctggagccaatattgcctttgccacacagcgcaatcgcgacgtgtttttgagcttggaagagctgtttgtgaatggcgttaaccaatgaatgaatcggcgtttgacgcagtacggcaaccaaactgaggcttgattctgacgcgctgataaactcgaccggtaaggcattcagctgttggtagaagccataacagtggttcgggtttttagtgacgcccgcaccgaccgcagcaatcaggtcatagccttctttgagtttgatttccgcctcgaacgcggcatcttgcagcgccgcaaacgcgccaggcgcaatttctgctgtgtaggctaaacgcaaacggtattggtcaggttgtgcttcgtaagtcagcggttgcagttgcacgcgctgcaagtgctgtaacacatcttcttgcacacgttggaaatcatggtgatgagcaaagctcagctcaatcagcagcacatcatcgagcgaagtaatgattttcgcgccgcgaccagaagccagtacccgttcaatacgggtagagcccgattccggttggtggctgcaacgtaagtgaagctccatggtgctctgcgcgacaggttggagtgtacggctgtgcagaactggcgcagctaagcgtgccagctcattggcttcatcgagtcttagcagtggcagcaaacaggcatcgctgacaatgcgtggatcggcactgtacacgccagccacatcactccaaatggtcacgcgtgagacttcagccagtgcgccaatcacggtcgcagaataatcggaaccgttacgaccgagcaggacagtatcgccctgttcgttttgcgccataaaaccggtgatcaccacgcggcgctgggtatgttgtgccaacacggctttcagtagtgggtaagagcgcgcgcgatcgacttccggctgtgtgcctgcttcggcacgtaaaaatgttcgcgcatcttgtgcgaccgctggtaaatcttgctggttcagtaacgcggcgagcaggcgtgccgaccagagctcaccatgtcctaaaacccaagcgtattgtgcgttactaagaggagctgtgagctcgcctaacacgctgatctcttgttgcagttggctaagtagtggttcggctgcttcgttgctgagtagcttagtaatcaattcagactgatattggcgcagcgcatgtaaggtttcatgggcaacgcgaccatctttactgagtgcttcgacaaaactgatcaaacggttagtggttttgccagccgcagaaaccaccaccagatcatcacttttggaataacttttaagaattttcgcgacacgttgataacactcagggtcggcaaggctactaccaccaaatttatgcaattgacggggatgggtcatttacagatctccttaattcgcggcaagagtgtgcaaaaaggcttggtcaagatcggcaatcagatcagaggcatcttcaagaccgacggaaagacgcagcaactgctgggaaattcccgcttcagctaaggcttcttcgcccattgcacgatgagtcatagacgcaggatggcaaataagactttctaccccgccaagtgactccgccagtgaaaacagcgccaacttacccacaaagaatttcagctgctcaaaactgccggcaaactcgaaactgagcatagcgccaaagccagattgctgttttttggcaatctcatgccccggatggtcgggcagacttggatgataaattttgctaaccaaagattgagtctgcagataagccaaaatctgttgcgcactctcttcatgcacgcgcatccgcgcgcccagcgtgcgaatgccacgcaaggtcatgtagctatcaaatggagtgccggttgaccctaaacagttgccccaccaagccaactcttcggcatgttgcttgtgtttacagatcaacacgccgccaatcacatccgagtgaccattaatgtatttggtggtggagtgcagcacaaaatccgcgcctaaggtgagcggtttttggaataccggggttaagaaggtgttatcgactgccaccaaagtgccttgcgctttcgctaactggcaaagatgagcaatatccaccacacgcactaaagggttggagggggtttcaatcagcaacagtttgggcttgcgggctaaagcttgggtgagtgcggctgcgttggattgatccacaaactgcactttgaaatcgccttttttagcgcgagtgttgagcaagcgataagtgccgccatagcagtcatgcggcgcgacaatcagatcatcagggcctaacaaggctgtgacccataaattgatggcagaagtgccacagttggtcactacggcaccttctccacattcaagctcatataaggtttgttctaaaagtcctcggtttgggttgcctgaacgggtgtaatcgtatttaggtacttcgccaaacgcgggaaaaccatagttggtcgaaagataaatggggggcacaacggcatggtattgagtgtccgattcaataccggtacgaaccgcaatggtggctggcttgcgtgtggtcatggagtttccttgctggctattctgtcctagagggcttcatcatatacctttcctgctttaagctgcagtgtcggttgtcgtatcgcaactttccctaactgggggatgaggtttatccgttgcccataaattactcgacactttactgatgttaaataaagacgtcaacacttctagacgtctacatgtctttgcttatggcggtaaatcccgctagaattagggcctttgaaatttcgattcgaaccacaataacgaaggtgcgcaatggcagactggaatggcgaatacatcagcccctatgcagagcatgggaaaaagagcgagttggtaaaaaaaatcacggtatccattccgctgaaagttctcaaagtgctaacggatgagagaacacgccgtcaagtcaataacttacgtcacgcaaccaacagtgaattgctgtgcgaagccttcttgcatgcttatactggccagccgctgccgacggacgaagacctacgtaaagatcgccctgatgatattcctgccgaagccaaacgtttgatgaccgaaatggggattgagttcgaatcttacgatgagtaacgattggcgtgagtgatacggggtcattgaacaaatccttgcttataaaaaagcccctcatataactgaggggcttttttatcgactttttatccaaataaacaagcagattaagcctgcatgtagttttctggcattgggatacgagcaacacctgattccactgccgcttccgcgacggcgcgtgctacgcgtggcaataggcgagggtccatcggttttggaatgatgtaatcaataccgaaactgagcttatccactccagcagctgccagcacttcggctggcacaggctctttcgccagttggcgaatcgcctctactgcagccagtttcatctggtcattgatttcactcgcgcgcacatcgagtgctccacggaaaatgaacgggaaacagagcacgttgttaacttggtttggatagtcgctgcgaccagtccccatgatcatgtcgttacgcacttgatgagcaatttctggcttgatttcaggatctgggttggagcaggcaaacaccacaggcttgtcggccatcagcttaagggcatccgctggcagcaagttagggccagaaacgccgaggaacagatccgctcccgcaatcacatcttccaacgtacgcttgtcggtgttgttggcaaacagtgctttgtattcattgagatcatcacggcgagtgtggatcacgcctttgcgatccagcatgtagattttctcacgcattgccccgcatttgatcagtagctccatacacgccactgctgcggcacccgcaccaaggcagacgataatacagtctttcagttgtttaccttgcaactcaagcgcattaagcataccagccgcggtgacaatcgcagtaccgtgttggtcatcgtggaatacagggacatcacaacgctcaatcaggcggcgctcaatttcaaagcagtctggggctttgatatcttctaagttgataccgccgaaagtatcagcaatgttagcgacagtatcgataaattcgtcgatcgtgcggtgttttacttcaatatcaatcgaatccaatcctgcgaagcgtttaaacagcagtgccttaccttccatgacaggcttagaggccatcgggcctaaatttcccaatcctaaaattgcggtgccgttagagatcacggccaccgtgttgcctttcgcggtgtacttatacacattgtcaacgttttgcgcgatttcacgcactggctcagctacacctgggctataagccagagcgagatcggcagcagaatcggctggcttggtcagtgcaataccaattttgcccgcggttgggtaagcatggtaatccagagcgcgttggcgaaattgttcttcaggtgttgggttgaggcgattgtcatcggacatagggctgttctcttattgttatttatgggggaggtcgcaaattttaaagtaactattgcaaactgcctaggttagacactgagcaaagcgtacaaaaaaagcgaagatcttgctgataagaccagtgaaaatgtgaatcgcggagaagaaatagccagaatatgccaattcaaagggttttatatgcagataagtgagtgtccaattcattctagctgaaagcgagatgagatagtggtggcggggcttaagctatgaaaaaaggacgccgaagcgtcctttttcaaaatctagcgtaaagcagaaattacttcttcgcagacagtgcgccgaaacgcttgttgaagcgctcaacacgaccaccggtgtcaacgatacgttgcttaccagagtagaatgggtggcacttgtcacatacgtctaggtgcattgtgtctttacctagagtagagttgaaaacgaaagagttgccgcaagaacaagttgcgtttactgctttgtattctgggtggataccagctttcatgggataacctcaatttaggccgtgtcgccatccgaatcgattgtcgtcggacaccacacgtagtgttaaaaataacgagtttgcatatccagagaggtcaaccctctaggatgccgtaaggcgcgatatattaatgaatctcgagtttcggatcaaccgatcgcgccgattatttcaccaaaagcgcgggtcgaatttctgtcaagcttccagtagactgtgatccgtttgatttttccctgttttggaccctgatgcgaccctccattgcccgagtttgcctacctgtacctctggataagtctttcgactatctgatcccagctcatctatttccagtgctgggcggtcgtgtgcaagtgccttttgggcgacaaaccttggtcggtattgtccagtcgctgacacatcaatccgattttcctatcgaacaactgaaatccgtgcaagccgttttggatgacgcgcccgtgtggccagataaactgcagtctctgctgcactggtgtagccagttttatcattatccgctcggtgaaacgtacgcgaatgccttgcccggcgcactgcgcaaaggcaaagcggcagagctgactagccataaagagtggcgtttgaccgcgcttggtcaagagcaactgatgcaaggggtgaagcgtggcgcggtaaaacaagcgcaagttctccatttgttgcagcacggcgctttatcgcaccaaactttgcttgatgaagaggtgagcagcacgaccctcaaagccttggtcgaaaaagggtggattgagtgtgaagagcgtaaacctgtggcgcgtccttggccgcaagagctggaagctaaagtcgataaacctaggcttaatcaagagcaggcgatcgcgattgcggcggtgaatagccagcaaggtttcggctgctttttattagaaggggtaacgggctcaggcaaaacagaggtgtatcttaacctcatcacaccggtattggcgcgtggtgaacaagccttggtgttggtgccggaaattggtttaaccccacaaaccatcaaccggtttcgccaacgttttaatgtccccgtcgaagtcatgcactcggcgctcaacgatactgaacgcctcaacgcttggctggcggcgcgcgataaagtggcggggattgtgattggtacgcgctcggcgctgctcacaccctttgccaaattgggcattattattgttgatgaagaacatgatagttcttacaagcagcaagatagcctgcgttatcacgcccgcgatgtggctgtgatgcgcgcgcatctggagaatattccgattgtgcttggctcggcgacgccagccttggaaacgttgcataatgcgctcagtggtaaataccatcacttgcaactgacgcagcgtgctggtaatgcactacccacacgtaaccacgcgttggatgtgaaagggctctatctggaaagtggtctgtctgcgcctttgattgcggaaatgcgccgccatttgtcggcgggcaatcaggtgatgctgtttttaaaccgccgcggtttttctccggccttgatgtgccatgaatgcggctggattgcggagtgccagcgctgtgatgcctattacacctaccatcaacacagcaatgagatgcgctgccaccattgtggttcacagcgtcctgttctccatcaatgcaaagggtgcggctcgactcaactggttactgtcggcgttggtacggaacagcttgaagcgcaattacacactctattccctgagtatcgttcagtgcggattgatcgagatagcacgcggcgtaaaggcagtttggaatcggcgttaaccgcgattcgcaaaggcgaatatcagattttgattggtacgcaaatgctcgccaaaggacatcacttccccgatgttaccttggtcgcgttgttggatgtcgatggctcattgtacagcagtgattttcgcgcttctgagcgtttggctcagctctttattcaagtcgcagggcgggcagggcgtgccagcaagccgggcgaagtggtgctacaaacgcatcatcccgaacacagtttgctacaagccttgctgcataaggattaccaccattttgccctgacggcgttggaagagcgtaagctggcgcagttgcccccttattctttcttgagcttatttcgagctgaagccaatcacaccgctcaagtggaagattttttgcgtcaagtgcgcgaaaccttgcgctgcaatccttggtttgatagcgaatgtatggtgctcgggccaacgcctgcgccactcgcgaaacgagcgggaaaattccgttggcagcttttactacaaacgccgaatcgcaccctgatgcagaagattttgcaaagcgcacgtccagcactgcaacaattaccgctggcgagcaaggtgcgctggtcgatcgatattgatccgcaagatttgagctaattcacatcgcgttttataacgctgatgtgtgttaattttgtcagcaaattaatgcttattatcgtgatgaaaatcacagtgactatgcaaaatttgttaatctcgccgtaactttctgttctgaatcccttagactatcggtaaaatccactcagtgaatcgttttcgttaagcccaacgtcatggttatggccatgatttctagcatgaacaagatttactgattgcaggttaagtcttacaagatcagtcatcatgagtgtgatgctcaacatcactcgatagagaaaagagggtaaaaatacatggcgacaatgaaggatgttgcccagcttgctggagtttcaaccgcgaccgtgtctcgtgcgttgatgaatccagagaaagtctcgtcgtccactcgtaaacgagtggaagaggccgtgctggaagcgggttactcacccaattctttggcgcgcaatttgcgccgtaatgaatcgaaaaccatcgttgctatcgtgccagatatctgtgatccctacttttctgagatcattcgcggtattgaagatgccgcgatggagcacggttatctggtgctgttgggggatagtggtcaacagaagcgtcgggagaactcgttcgttaatctggtgtttaccaaacaggcagacggtatgttgctgctggggacagatttgccgtttgatgtgagtaaacctgagcagaaaaacctaccgcctatggtgatggcgtgtgaatttgcgccagagctggaattgccaacggtacacattgataacctgacctcggcatttgaggcggtaaactatctcactcagcttgggcacaaacggattgcgcagatctcaggtccacaacatgctgcgctgtgccaattccgtcatcaaggctatcaacaggcgttgcgtcgtgctggcatcaccatgaacccgacttactgcacttttggcgatttcacttttgaagccggggcaaaagcggtgcgtcagctgttggcattgcctgagcagccgaccgcgattttctgtcataacgatacgatggcgattggcgcaattcaggaagcgaagcgacttggcttgcgcgtaccgcaagatctctctgtggtcggttttgacgatattcagtttgcccagtactgcgatcccccattaaccaccatttcgcagccgcgttatgagattggccgtcaagccatgctgatgatgcttgagctgcttcgcggacacgatgtacgtgctggatcgcgtcttttggagaccaagctggtcgtgcgtgagagtgctgcgccgccaagcaagaagtaacccaccttcgaaaccgagtttcatgcttgaaaggtttgaactcggttccttttttcgttcctgtcgcagcgctgagatcggcgataaggccagttgtttgggcgtaactctgttatctggcagcgatctgcattaacatgtggacaattttgttaatttccgaacaacaacgtggctaatagagattatgtaagaggcggtcgtagtccgaagaagccgacccgtagaaaagcagcgccgcgccgtaaaccatggcgtagtggtttagtcgctttagtactcatcgcgggctttggttatggcttgtatttgctcagcaacgacccggaacctaaagtcaacactcaggtgtcgacgtcatcatcgacatcgagcagtaaacctaagccgacagaaacgctaccgcccccgccaacggaaaagtgggactacgtagacaccttgcccaatcgcgaaattgaagtcgtggccaaagagcaggaagtgtcggatatcccttacgtgatgcagtgtggtgcgtataaaaccgcagaacaagccgaagcgcgtaagctggatatcgctttccaaggcatcagcagccatatccgtaagaaagcggacagcagttggtatcgtgtcgtcctcggaccttacaaatttaagcgcgatgctgagcgcgataagcacaaactgcaacgcgcaaaaatcgagccctgcgctatctgggctgaaaagcagtaagcgactccccaaaagcctgatgttgatcaggcttttttgttggcattcggtcaacttctctcgcttggcttgaaattgttttccggtagccgcatataagcgggtaactctccgataaaaattaaagaggcctcttgtgactactatcgtatcagtgcgtcgtaataataaagttgtcatcgctggtgacgggcaggtatcgctaggcaataccgtgatgaaaggcaatgcacgtaaagtgcgccgcctttataacaacaaggtactggcaggctttgctggtggaaccgctgatgcatttaccctgtttgagcgctttgaaagtaagttgcagatgcaccaaggtcacctgaccaaagcggcggttgagctagccaaagattggcgaagcgatcgcgcgctgcgccgtttggaagccattttggcggtcgccgatgaaaccgcatcgctgatcattaccggtaatggtgatgtgctgcagcctgaacacgatctgattgcgatcggttctggtggcaactatgcacaagcggctgctattgctctgttagaaaacaccgagcttgatgcacgcacgatcgccgaaaaagccttaaatatcgcgggcgatatctgcgtgtttactaaccaccatcacactatcgaagaactcgaaattccgcaggcgatgttgccacaaggcgcatctgcgtagatcaataagtctccggcaaataaccacaagatagtgcccgaaaagctgagtgaaggatttgaatcatgtctgaaatgactccccgcgaaatagtgagcgagctcaatcgccacatcataggtcaagataaagccaaacgtgccgtagcgattgcactgcgtaaccgttggcgtcgtatgcagcttgaagagagcttgcgtgttgaagtgaccccgaaaaatattctgatgattggcccaaccggtgtcggcaaaactgaaattgctcgccgtttagccaagcttgcgaacgtgcctttcatcaaggttgaagcgaccaaattcaccgaagtgggctatgtcggtaaggaagtggaatcgatcatccgcgatctgactgatgttgcggtgaagctgacgcatcagcaagcgatggagaaagtaaaattccgcgctgaagagttagcggaagagcgcgtattggatgcgctgctgcctccaccacgcgatgcgtggggacaagcagagcaaaaagaggagaactccagcacccgccaagtatttcgtaaaaagttgcgtgaagggcaactgaacgacaaagagattgaaattaacgtcgctgtaccgcagatgggcgtggaaatcatggcacctccaggcatggaagagatgaccaaccaactgcagggactgttccaaaacctcgcgggcgacaccaagaaaaagcgcaaaatgaagattaaagatgcgctgaaagccttggtggaagaagaagccgctaagctagtcaatcaagaagagctgaaagagcaggcgatttacaatgtcgaaaataacggcatcgtgtttatcgatgaaatcgacaaaatctgtaagcgtggagaagtctcgggtcccgatgtttctcgtgaaggggtgcagcgcgatctgctgcctttgattgaaggcagtacggtatccaccaagcatggcatggtgcgaacggatcacatcctgtttattgcctcaggcgcgttccaagtagcaaaaccgtcagatttgatcccagagctgcaaggccgtttgcccatccgtgttgagttggaagccctgtcgagcaacgacttcaaacgcattctgactgagccgaaagcatcactcaccgagcaatatgttgcgctgatgaaaaccgaacaggtggatgtgcagtttaccgaagatggtatcaagcagattgcggatgcggcatggcaagttaacgaaaccaccgaaaatattggtgcgcgacgtctgcatactgtgctggagcgtttaatggatgaaatctcctttgatgcaacagaaaaagccggccaagccttcgtgatcgatgctgcttacgtgaaagcgcgtttgggtgagctggtcgaagacgaagatctcagccgtttcattctctagactgcttaatttttgaagtgaaagcccacccgaatttggtgggcttttttatctgggtgatttgcgcgtatactgacgccatgttgatcgtactctcattatcatgaataactctgtgcaaatttggttggatgccgcgcgtccgaaaaccttgcctctggcgctgatctccattttaaccgggagtgcattagccttctctgcgggaaattttcactggctgatcgcggtgttagctctgctgaccgcgactttgctgcaaattctgtccaatcttgccaatgattatggcgatgcggtgaaaggcaccgacaaccatgctcgtttaggaccgatgcgcgccattcaatcgggggcggtgagcttaagtgatatgaaacgcgccatggcgatcaatgttattctgaccatggtgtcaggcttggcattggtgctgtatgcctttgataacctgcaaaatatcttgatatttattggcttaggcgtattggcgattttagcggcgattgcttataccgtcgggaataaaccttatggctatgtcgggcttggcgatctatcggtattcctattttttggcttgcttggcgtctccggcagttttttcttacacactggctatatcgaatggagcttgttattaccgtctttaggctgcggtttactggcggtggcggtactgaatgtcaacaatatgcgcgatattgaaaacgatgcgcagtgtggcaaacgcactgtggcggtgcgcttgggacaagtgcgtgcgaagcagtatcactttgctttgttgtttggtgccgttgccgcgtttgcaggttacctcgttttacaagacaaaccactgtggatcagcttgccctttttgctctgtttgtcggtggtgactcgtcacggtcgagccgtctggtttaccgagcaacccgcgcaaattgcccccatgatgcccgtggtggtgaaaacgtcggtgatcaccaaccttttgtttgttggagtgatcattgcccaaactctgacaagttaatttgcactctgtcattgcaatgactcaatcactctatatactcgttggaagactttcgctaagagaacaaagctatggaatacaatacttctgcgctgtgtgatatctatctcgaccaagtcgatgtcgtggagcctatgttcagcaactttggtggctgtgcttcgtttgccggtcaaatcaccacgattaagtgctatgaagataatggcttgatccgtgaaacccttgagcaagatggtcttggccgtattttgctgattgacggtggcggctcgctgcgccgtgcattaattgatgcagaattggcggctctagcggaagaaaatgagtgggaaggcattgtggtgtatggcagtgtccgtgaagtggatgaattggaagagatgagcatcggtattcaggcgattgcttctattcctgtcggcgcaacctcgcaaggcatcggtgaagtggacattccagtcaactttggcggcgtcaccttcctaccagaagattatctgtatgccgacaatactggcatcatcatctcgcaagagccgctgagcgcggatctgggcgaagaagaggaagatgagttgctgtaagcgagctctcgcactctaagaattgaaaaagccgatgtcgttgatatcggcttttttcatgcattctctattggcttgtaacgagcttaatccaaatcaggcgtaagggtttgacgccgcaatctgagcgcatagagataacccaataatccgcccagtatgttccccaccgcaataccgataaataacccttcaatgttgtacagtctgccgccaatccaagctgcgggtagggtgaacacaaacaggcgcataaagctccattgaaaagccttgagtggttgatgtaaggcgttgagggcggaaaccaacatcatcaccacgccttggaagccgtagctgaccggcacgactaacaaatagtgccacagcagatcgcgcacggcttgctcttgagaaaacagcgccgccagtggaatactcagcggtaccatcatgataaacaccataagttgaaacagcagagaaaagcgtagactcagaaagagtccggcaaagcagcgtgcaggattttgcgccccaagattttgcgccataaagggggtgagggcagacgtgagcgacatcagtaccaaaatcagaatcgactcaatgcgctgcgtcgcaccatacgcggccaccgctgcagtgccgtggcttgagagcatgatcatcagcagtgcgccagaaattgggttcattgcggtagaaagcgcagccggagtgccgatttttaaaatctgttgccagtcatcgcgcagatgaggcagcgatggtatggcgagcagtttttcacgcttgatcagcaaatagagtgagccgattaatgcccccaaccaagagaaagcgctagcaatcgcagcaccttggatgccgagttcaggaaatgggccgtagccaaaaatcagcagtgggtcgagcgcgccgttaatcagccccgccagcatcataattttggcgggtgttttggtatcgccagtggcgcgaatcgcgctgttaccggccataggtagcacgagcaggggaatcgtgaggtaccacaccaccatgtactctttgataagagggatcagctcatggctggcaccaagcagcaaaaacagcggttctatggtcaataaaccgagtgttgaagctgcggccactagcaataaggcgagcagtaacccatgactagacacgcgcgcggcttgtcgtccatcaccttgtccgagcaagcgccctatgcaagtggataacccaaccccaatgcccatggtaatacagttgaccgcaaaggtgaccggaaaggtataactgattgccgccagcgcctgtgtacctagtaaggaaataaagaaagtatcgacaaggttgaacatcaaaatggccaccaaaccgaaaatcatcggtacggtcatttgccgtaaaacgagggggatgggggcagaaagcaggccgtgtttatcgtgcataagctgggcaacgaaggaaaacaaggtgcctagcatacctgaacttaaaaacagggactagggaagggagcctagggagtaaattgcgaggggctaaaaacaacaaggccagcattatgctggccttgaacgatcagtggcgagaatcgcaaattacgcttttttcgcttctgctgcggctttggcgatcgcggcaaagcctttcgcatccagtgatgcaccgccaaccagcgcaccatcgatgtctggttgtgcaaagtaagacgctgcgttttctggttttacggaaccgccgtactggatgatcacttgctcagccactgcagcatctttcgcagcgatcagtgcacggattgacgcgtggatacgctgtgcatcatctgctgtcgcggctttacccgtaccgattgcccagattggttcgtaagcgatgatcgcgccgttcagtgcttcaacgccgtaagcatcgatcactgcgttgatttggcgagcacataccgcttctgtttcgcccgcttcgttttgcgcttcagtttcaccgatacagaagactggcgttaggccgttttctttcaggaacgcaaatttcttagcgacgaactcatctgattctttgtggtaatcacgacgctcagagtgaccgatgatgatgtgcgaagcaccgaaatctttcagcatcgcaggagacatatcacctgtgtacgcaccactgttgtgagtatcggtgttttgtgcacccaggatcagcttgttgccgccttctttgatcaggcgctcagccagatccaaatacattgctggtggcgcaacgacaacatcaacaccttcaacaccttcaagttctgcattcaaaccgtttagcaggtcagtgaccatagctttgctgccattcagtttccagttacccatcacaacaggacgacgcataggaatatctccatatctaatcaatgtaaaaaataaactcgcaggactatagcagaataaattcgtcagatcatgactcgtatcatgtctttatgggatctcatcgacgcgacaaatcagcaatcgagtgatctgagtgacagattattcggtagtggctcggttttttaggttgaacttgttattactatccctctctctaggacagaacgatttttatccaccgttagcaaggaaaaccgaatgccaaacttagtcatggaatactcaaactcagtcgatgaacgcatcaatgtgcaaggattgctggaagatttgcatcgagccgctattgattcaggactgtttgaaataagttcggtaaaatctcgcgcgctgcgctgccaccattggttgattggggatgaaggcgacagcgttgattttattcacctcagttttgagttgctggcaggacgcagtcctgagcaaaagcgagagctatcgcgtaagctgatggagattctggcggcgaaagccagccatgtgcgcagtttgaccattaatattcgagatatggatacagactgctttcaaaaagtcatcaatcgatgaccttgtttaggtaaaagtcatgtcgttacaaacactgttgttttcttttcaggggcgtattggtcgccaagctttctggctgtggaatatttgctactacgccatgattgccggttttgcaatgggatcgaatctgctatttcccgatgttgcgcacctgatcttgccggtttttctgctggtagtcttagtgccagatttggcgattaccgctaagcgttggcatgatcgtgacaaatcaagctggtggttgctactcaatgtgccgcttgtgattggccgcatgacgattccggcaggagaattggccgtgaatacccaacccggcatgctggaaacacttatctcgtttgtggccttactgtgtggtgcatggattttggtggagtgcggatttctttctggcacggatggcagtaaccgttttggcgccgagccgaagtggatcaaaaaaagctaggccagcaataagcggtatcaaatgcgtaagagaggaggtttctctcctctctttattgtcatccctaaaccaccgcttttagcggtggtgattgttcttgccacttttccatctcggctaagagcgttatcgccagccgtcgtcttgaaccattctcgggcgaaacggcaccacatccgcgacggtatcttgctgcaaatcgccctctaatgcattacgaaaacgcaccatttgttggctcagttcacgcattaaggttacgttggcgtgtacggggtttttgcattgacccaccacgcgatcaatatggctctgctgtgcccaaagcctttgctgcatggcgtgcgaggcagagaggatcatctcttcgcacatctccttcttaaactgatcaaaagcatcaggatggtgctttgcgagggcgaccaactcatcaaagggtggtagtacctgattacaaggttcgggtgagtgtgggggcgtcatgtggcaatcctccgcctttggctaaactgatgcttttatcaacaatactagcttaagcgatttttgcgcagttcggcggaacgaatatcgcccttcttataaataagacgaaaagggctaaaaacagcatgagagagattatcgcgcggcaataaagtaagtgcagcgacgctctccggcgacaatgtgttcgcggcgttcgatatggcattcttcgcccaataaacggcgaaaaacattcaactcagattggcacaggctgggacagcgggtggctgctttgcaaatcgggcagtggttttcaatcaaaataaagccgtcggccgtcgactctaactcggccatatagccttcttgttcgcgcagggtaaccaaagcttcgagtttttcttgtagagagtggcactccactaaggcgttgtgataggcagcaaaggtttgggcttcccgttccgccgccaccttggcgagtccttctttaccaaaaatatgctcgaccgcatcaatcacttgaatggtcagctcaccatgacgatcggcaaactgattgtgtcctttcgcggttaaagaccaatggcgagtcggacgaccgaccttgactttcacatcatgaaaggccagcacaccttcttcttccagactttgtaaatgctgacgagcgcccatggtcgtgatacctaggtcttcagccaactgtttggcggttactgtgccttcacgtttgatcgtgtgaagaatgcggtcaaccgttttcatcgtctcttattttcctaacaaggtgtggtttctaagcggagccattgtgcctgtcaccattcattttgggtgttgctggatcggtgcctctttatactgccgttattatggaatgcgaatttaataaagcaaactatttactatacctaaggactcgctagcgggttgcccttgatcaccagcaggatcgaaagcgccaccctgcccagagcgatttgctgtttgaaaatgttaaattaatcacgtttttttacgcttgcccccttgggatatggtgcaagttcccccacatatgtgacacatgctgatgatcagcgttttatcaaccatacggaaaattaaatcaggagagacgaccgatgaatattcgtccattacatgaccgagtgatcgttgaacgccaagaagttgaatcaaaatctgctggtggaattgttctaactggttctgcggcggaaaaatcaacgcgcggtaaagtgttggctgttggtaaaggccgcattctagagaacggttcagttcaacctttggacgtgaaagtaggcgacaccgtgatcttcgcagaaagctacggcacaaaaacagaaaagatcgatggcaaagaagtgctgatcttggctgaacatgacattttggcaatcgttgaataattgattctgaatcccaacgaaatcaataactgaatttagaaaggaaatgaaaaatggctgctaaagacgtacgttttggtaatgacgctcgtgtaaaaatgctagaaggcgtaaacattctggccgatgcggtaaaagtgaccttaggtcctaaaggccgtaacgtagttctcgacaaatctttcggtgcaccaaccattaccaaagatggtgtatcagttgcgcgtgaaattgaactggaagacaaattccagaacatgggcgcacaaatggtcaaagaagtcgcttctcaagccaacgacgcggcgggtgacggtacaaccacagccaccgtactggctcaagcgattgtgaacgaaggcctaaaagcggtcgcggcgggcatgaacccaatggatctgaagcgcgggatcgataaagcggttatcgctgcggtagaagagttgaaagcactgtctgtaccttgtgccgatactaaagcgattgcccaagtaggtaccatctctgctaactcagactctagcgtgggcaacatcattgctgaagcgatggaaaaagtgggtcgcgatggcgtgatcaccgttgaagaaggccaagcgctgcaagacgagctggatgtggttgaaggtatgcagtttgaccgtggctacctgtcaccgtacttcatcaacaaccaagaatcaggcagtgtagaactggataacccattcatcctgctggtggataagaaaatctctaacatccgcgaactgctgccagtactggaaggcgtagcgaaagcctctcgtccactgctgatcgtggctgaagatgtggaaggcgaagcgctggcgactctggttgtcaacaacatgcgcggcatcgtgaaagtggcagcggttaaagctcctggctttggcgatcgtcgtaaagcgatgctgcaagatatcgcgatcttgactggcggtgttgtgatctctgaagagatcggtctggagctggaaaaagcgactctggaagacctaggccaagcgaaacgcgtttctatcaccaaagaaaactcaaccatcatcgatggtgctggcgatcaagccgcgatccaaggtcgtgttgcgcagatccgtcaacaaatcgaagaagccacttctgactacgacaaagagaaactgcaagagcgcgtagcaaaactggctggcggcgttgcagtaatcaaagtgggcgcagcaaccgaagtggaaatgaaagagaagaaagatcgcgtagaagacgcgctgcacgcgactcgcgcagcggtagaagaaggcgttgttgcgggtggtggtgtagccctgatccgcgcagcttctaaactctcttctctggtgggtgacaacgaagagcaaaacgtgggtatccgtgtcgcactacgtgcgatggaagcgccactgcgtcaaatcgtgaaaaacgcgggtgacgaagaatcagtggttgccaacaatgtgcgtgcaggcgaaggtaactacggttacaacgcggcaacgggcgtgtacggtgacatgatcgaaatgggtattttggatccaaccaaagtaacccgttctgctctgcaattcgcagcgtctgttgcgggtctgatgatcaccactgaagcgatgatcactgagctgccgaagaaagatgcaccagcaatgccagacatgggcatgggtggcatgggcggcatgatgtaatcatcccccttagcaggaaaagccggagcccaagctccggtttttttatgccgtggttatgctaaagcatggttaagataggtcagcatgaccaagaacatgaccataaactgcgcggaaaaatgacacaatattcacattaccttatgcaagatatggataatgttgcctagttttcccccttatccatcctgattggaggttatttttatgaacaagccgtttgctttgatggcgcttactgcagcgatggctgcaccagccgcattggcttcaacacccgttatgttctcttctatcgataatttcaacacgccagatgcgaaccaagttgcgggtgtacgtttgtcggcactgcacggtaaagtgaatgaagtcaaaggggttgatttctcgattcttggcctgtctgaaactgacaaaaccacaggtgtgaactttggcttattcttcggtgcaagcaaagtgaaccaagagatgacgggtgcatctctgggtcttttgaactggaacacgggtaatacttatggtgcgaacctaggttttgtgaacctgactcatgatgtgaaaggcgcgaacttgagctttgtgaactactcagaaggtaacactctcgttgacttaggtgcggccaacttctcgaacacttcaacagtgcagtttggcctattcaacaaaacggaaaaaatcgaaggcgtgcagattggtttgatcaactgtgcggacaacggtttctttaagtgtttcccaatcattaactttgcgaagtaatgatgcaaaaagcgttgccgaggcaacgctttttctttattcaagatgcagatcaagcggtgttttgctgggcctgccaccgatttctcgagttaatttcggtaccagatagcctgacacctgttcaattaagcctgccataatctgccttgctttatcatcactgacgtaaaaatgcgccgcgccttgcaccttatccaacacatgcaagtaataaggcagaatacctgcatcaaacaaggtttcgctgagcgacacttgtgcgtcaaccgtgtcattgacccctttgagcaacacaccttgattgagtaaggtgacattgacggctcgcaaacgggccatctgctgtttaagctcaagattgatctcattggcgtggttgatgtgtgtcaccagcagtacttgcaagcgggtttgcgcgaacagttcaaccaattcatcggtgatgcgcgcggggatcaccacgggtaatcgcgagtgaatgcgtaaccgtttgatgtgcggaattgctgcgatacgctccatcagccatgcaatttcatgatctttggccattaaaggatcgccgccggagaaaatcacttcgttgagctgtggattttgcgcaatgtaatcgaggctttgttgccaagcgcttttgccgcctttgttatcttcatagggaaaatgacggcgaaagcaataacggcagttgatggcgcaaccacctttgacgatcaacaagcagcgatttttatacttgtgcagcaagccgggcacggtgttgttttgttcatccagtgggtcatgtgagtagccgggatgaatctcaaactcagcactcaacggtaaaacttgccgtaaaagtggatcggcaggattgcctttttgcatgcgatcgacaaaactttgcggcacccgctgcgcaaacagtttgcgcgcttcaaatccgtcttgccatggcgaaggatcgatctcaagttgctgcaataattgcagaggatcggagatcgcgtttgccagctgttgcaaccagttttgctcaacagaaatgacttttcgggttatgatgtgcggcattgattttaactcgaagatagtaagaggaaaaaatggctactgttagcacgaatgaatttaaaggcggtctcaaaattatgcttgataacgagccttgtgtcattctcgaaaacgagtatgtaaaaccaggtaaaggtcaggcattcaaccgcgtgagaatccgtaagctgcttactggtaaagttctggaaaaaacctttaaatcgggtgacacagcggaagttgctgatgttgtcgatatcgatctggattacctgtacaacgatggcgaattctaccacttcatgaacaacagcaccttcgaacagcttgctgcagatgcaaaagcggttggcgagaatgcgaaatggttggtagaaaacaacacttgtatgctgacgctgtggaatggtaacccaatcgcggtcactccaccaaacttcgttgagctagaggtgactgaaacggatccaggcgtgaaaggtgacactcaaggtactggcggcaaaccagcgactctgtctaccggcgctgtcgttcgtgtacctctcttcgtacagattggcgaagtgatcaaagtggacactcgctctgcagaatacgttggccgtgtgaagtaatcaccgcggtcacaagaaaaaaccaaccttgcggttggtttttttatgcgtgtagttttagccttgcaatcaaaaagctggcctgttgtcagccagcttttttatgtttcatgttagatcatgaagataaacacgaccgccagtgcggagatgatggttgcaaagccgtagcaagcgattttccctgccacaccggtgtggaatttcaaatcatgcatcccgtggtgaacacggtgcatggcatgccacattggtagagctaaagtgccgatgatgaacagtgcaccaatgatgctagttgcaaagctagacactcgctcatagctcagtgcttcggcatcaattactcccagtggcgcaagaatgcccagtaccagaacggtaatcggggtgatcatggcaaaccaagtgccaccagcaccaaacaggctccaccatacgggttcgtctgaacgttttgggttggtattaatcacaataagctccttacaccacaataagaacaatcagtgagataaaggccacggccgcccactgtgctagcacgatgatctttttatcaaccagtttgccgcctaaacgaataggcacgacttgtggcatcatgctaaagaaggtttgcgcatggaataagcttcccgccagcgccactaggttgatcgcaatgacgagtgggttagccataaaatccaaccaggtttgccatgcttcagggcctttcaccagagaacctaaaccaacggtgaggaacagggtaaacaggatcaatggcagaaccgtcgcttcacgcaccatgtagaagcggtagaaaggatgatccttccaccaagtgcgtttcatttcacgaacataaggtttacggttactcatccttaggcctccactttcttcggtgaaccatctgggttcaacatcgcgatcacgaagtctaatgaggactccactttgccttggtttacggctgccgctgggtcaacgtgttttggacacacttcagagcagtaacccacgaaggtacaaccccaagcgccattatcaccgttaataagcttcatacgctcggctttaccgttgtcacggctatcgaggttgtagcggtgcgccagagtgagtgccgcagggcctaagaactcagggtttagaccaaactgtggacaagctgcataacacaaaccacagttgatacaaccagcaaactgcttgtagcgtgccatttgctctggagtctgcaggttagtgccgtcttcaggcttacgatcgttacctatgatgtatggtttgatcgcttccaaacgctcgatgaacggcgtcatatccacgattaggtctttctcgatggggaagttggccagtggctcgatctttacgccttctgggtaatcacgtaagaagctcttacatgccagttttggcacgccattaaccatgatgccgcaagagccacaaatcgccatacggcatgaccagcggtaagaaagatctttatctaagtgatctttcacatagccaatcgcatccagtaccgacatagtttcatcaaacggaacttcgaagcgttgcatgtgtggctctgcatcgttggctgggtcgtagcgcagaatgtccactttttgaatacgttgtgctgacattatttttgctcctctacgctttttccggccgcttcagctgcggcagctttttcggctgcttcaccgtacagacgcgcttttggctgcgacttggtgattttcactgggctgtaatcgatcttcggtgtttgaccttcttgatagaatgccaaagagtgtttgaggaattgcacgtcatcacgctcggtgcaaccttcatcaagacgttggtgtgcgccgcgcgattctttacgcagaatagcggagtgaaccatggcttctgccacgtctagaccgtaacctacttcaatcgcgtatagcaggtcagtgttgaacactttgcctttgtctttgatgctgatgcgcttgtaacgctctttcaactcggccaatttgtcgatggtttcttgcatcagatcttcctgacggtagataccacaacccgcttccatggtgtgacccatttctgtacggatggttgcccagttttcatcaccttcttgctgcatcagtgctgcgatgcgatcttcaaccgctttgacttgtgcggcgatggctttttcattccagcctttaaactctgcagcgcgctcaaccgctttttcaccagcaacgcggccaaagactacgaattccgctagtgagttagaacctaaacggttcgcgccatgcagaccaacagacgcacattcacccacggcgaacagacctttaatgcgggtttcacattcgccattggtttcgataccacccatggtgtagtgcacggttggacgaattggaatcggctcttttgctgggtcaacgttgacatacgcttttgccagttcacagataaatggcagacgttcttgcaggtattcttcacctaagtggcgcaggtctaggtgcaccacatcacccagtgggtgtttgatggtgttgcctttttgctgctcatgccagaaagcttgggaaactttgtcacgtggacccagttccatgtatttgttctttggttgacccactggagtttcagggcccataccgtagtcttgcaggtaacggtagccatgtttgttgacgataataccgccttcaccacgacaaccttcggtcatcagaataccagtacctggtaggcctgttgggtggtattgaacgaattccatatcacgcagaggaacaccgtgacggaaagccatcgccataccatcaccggtcactatgccgccgttagtgttgcagtggtaaacgcgacccgcaccgccagtggctagaacaaccgacttagctttgatggtgaccagctcgccttccgacatatgaatcgcaatcaaaccttggatttcaccttcatcaaccagcaaatccaccacaaagtactcatccaatcgcttgatttgtgggtacttcattgaagtttggaacagggtgtgcagcatgtggaagccggttttatcagcagcaaaccatgtgcgctcaactttcatgccgccgaagcgacgtacgttgacttcaccattctctttacggctccaaggacaaccccattgttccatctggatcatttcgcgggttgcattggcaacaaagtattcaacaacatcctgttcacatagccagtcaccaccgccaacggtatcgttgaagtggttatctagactatcttcatccttgataactgctgcggagccaccctcggctgcgactgtgtgagaacgcattggataaactttagaaatcagagcaacttctaaatgagggtttgcttctgccgctgcaatagcagtacgaagaccagcgccaccagcgccgatgactgcgatatctgtggtgagaatttgcacagttatcctccagtgtgattattttattttatggactgagttcgtttcagtacctagagttttcaaagcattgatttggaagttactgagatggaactcactgactcaacacctgaccacccattaagtggtaggggtagtgtaggagagcttgaagaatgaaaaattgattctgttgggcttttgcttcggtattgcaaacttaagcatactatttgccctatatgtgactggtgtcacaattgagtttggctttttgttctgaaagagtacaattcgttatctctgtttcttgtgatgagccacccatgactaattccgattggatgccgaccgcatcaataagccaattaaaacaacgcgcgaccttgttgcgtcagattcgtgaattttttgctgagcgcaatgtgctggaagtcgaaacgccagccatgagccacgccacggtgacggacatccatctgcacacgtttaaaacggaatttgtcgggccgggttatgccaaaggcagcgcgctgcatctgatgactagccctgaatttcatatgaagcgtttgttggccgcgggcagtggttgtatttaccagctgggtaaagcttttcgtaacgaagaaaatggccgttaccacaatccagaattcaccatgttggaatggtatcggattggttttgatcaccatgccttgatggatgaaatggatgccttattgcaattggtgctgcgttgcggcagtgccgagcgaatgacttaccaagaagcgtttttgaatgtgcttggcgtttgcccactcgaagaggagatgcgtgagttaaagcaagtggctgcaacgctgggtttaagtgatatcgcagagcctgaagaggatcgtgacaccttattacaactgctgtttagcattggcattgagcctaaaattggccaaatcacaccagcatttgtgtatgattttccggcttcacaagcggcgctggccaaaattaatccggcggatccgcgcgtggctgatcgcttcgaagtctattttaaagggattgagctcgcgaacggcttccatgaattggataaccctgccgagcagttagcccgttttaaagcggataatgccaagcgtttagagatgggactgacagagcaaccgattgattaccatctgattgcggcgctggaggccggtttgccagaatgtgctggggtggctttgggtattgatcgtctgattatgttggcgcttggcgaggatcatattgataaggtcaccgcatttccatttcctcgagcctgatcggattctcagtttgcaacatattcaccctgttcagacccagttttaacgaggtaagcgctcgcgtcatgctgccaacctcgttatactccttgtctgatttgaatccccattgcaagagcacaggatatgcaagagtacattgagttttttcagcaaaatatgatcctttcactggcttggatcggtattttggtcgcgttaatcgccagcatctacaaatcggccaccgcggcttatcaagaagttacggccacccaagccactctgttgattaaccgtgaaaacggcatcgtggtcgacatccgtagtaaagatgaattcaaacaaggccacattaccgacgcaattcacattttgccgtcagacatcaaggcgggtaacttggctggccttgaaagccataaatcgaaccccattattgtggtatgcaaaacaggtcaaaccgcacgtgaaagtgcagatttactgaccaaagccggttttgagaaggtcaatcttcttaaaaatggcttgattgcttggaatgaagctaacctgcctttggtacgcggtaaacgctaaatccttagagcaccccgtcggcgctggtgaaaagatcagcgcttgacgctcagagttgtgatatctaccacgtaatggcttgcccacctagtgatcgcacacactctcagttagtctcaggacacattgacctttgaaccgaattatctgaattaaggatgaaatcatggctgaagcagcacaagccccacaacaacagtttgctatccaacgtatctatctaaaagatgtctcttttgaagcgccaagctcaccagtgatgttccaaaaagagtggaacccagatgtcaaactggatctcgacacgcaaagccgtgaactgggccaaggcgtttacgaagtggtactgcgcctgacagtgactgtgaaaaacgcagaagagaccgcattcctgtgtgaagtacaacaagcgggtatcttcagtgcagagcagatggaagcaggccaattggcccattgcttgggtgctttctgcccgaacatcctgttcccatacgcacgtgaaaccatttcaagcctagtggtgaaaggtactttcccacaactgaaccttgctccagttaactttgacgcgctgttcatgaactacctgcaacagcaagctcaagaaggcgcaacggcgaacgcataattcgcgcgattgagttttcagtaagaataaaatgcacagcgccaccgcgatgtgcattttttgtttatcactcgagtattggtttttgcactctttatctaaggcagccttggcgaagaaggtgcagactgcaatagcctatgtttgggtatagaatagagcacaacttcgttatcgataggcggaacaatgagcgaaacacagaaccacaatagctacggaaaacctgttgaaatgaccgtgataggtgcgggctcctacggtacctcactggcgatctctttggcgcgcaatggcgcgaatatcgtcctgtggggacatgatgcagagcatatggcgcgccttgacgctgaccgcgctaaccatgaatttttgcccggaattgcttttcctgacactctgattgtggaaactgacttgcaaaaagcggtgcaagcgagccgtgatctgctggtggtagtgcctagccatgtgtttggtatcgtgttgaaaagtttgcagccacacctgcgtgcggatagccgcatttgttgggcaaccaaggggctagagcctgagactggacggctactccaagatgtcgcccatgatgtacttggtgatagctacccccttgcggtgctttctggtcctacttttgccaaagagctggcgatggggatgccaaccgcgatttcagtggcttcgccggatgcgcaatttgtacgtgacctgcaagagaaaattcactgcagcaaaactttccgagtgtacgccaacagtgactttatcggtatgcagcttggcggcgcggtaaaaaacgtgattgcgattggtgcggggatgtctgatggtattggctttggcgcgaatgcgcgaaccgctcttatcactcgtggcttggctgaaatgagccgcttaggcgccgctttaggcgcgcagccggaaacttttatgggtatggcaggattaggtgatttagtgctgacttgtactgacaaccaatcgcgtaaccgccgttttggtttggcactaggtcaaggtaaagatgtggataccgcgcaaaccgatatcggccaagtggttgaagggtatcgcaacaccaaagaagtgtggatgttagcgaaacgcatgggcgttgagatgccgatagttgaacaaatttaccaagtattgtatcaaggaaaagatgcgcgactcgccgctcaggatttgctggcacgagataagaagatggagcgttaatccgcagcgcaagagatggaattgaatcgatagggtatagcttgccctatcttgattaggactgagtaagtaatgaaacagtgcgcccacaccaaggtttggcaaaccattgtcgctgaagctcgcgagcaagccgagcaagagccgatgctcgccagtttttaccatgccaccattattaagcatgacagtttaaaagcggccttgagctatattctggccaaccgtttgaacactgcctccatgcctgcgatggcagtacgagaagtgattgaagaagcgtttgctgccgatccgagtatctcagaagcggcggcgtgtgatatttgcgcgacagtcaaccgcgatccggcagtgtcgatgtactcaatgccgctactttacctaaaaggttatcacgctttacaaggctatcgggtggctaactggttatggcgacaagggcgtaaggcgctcgcgacctatttccaaaatcagatatcagtggcgtgtcaggtggatattcaccctgcagcgcgtattggtcgcggcatcatgctcgatcacgcgacggggatcgtgattggtgaaaccgccgtggtagaagatgatgtatcgatcttgcaggacgttacgcttggcggtaccggtaaagagtgcggcgatcgccacccgaaaattcgggaaggggtgatgattggtgcgggcgcgaaaatattaggcaacatcgaagttggagaaggggcgaaaattggctcgggatcggtcgtgttgcaagctgtaccgccccataccacagtcgctggagtacctgctcgtattgtggggcggccacaatcggataagccttctttggatatggatcagcagtttaatggtcgttcgcagacgtttatcggcggtgatggtatctagaggctctctctatctctgctctcacggtatttaagtactcattccgcgcttgagcaaaaaataaaaaggatgatggtgacatcatccttttttacatcgacaggtttggcttggcttatgccatcgcgttcaattctgccaacacttcgtccgcccattgaatccatgcttggcgaaccagtaaattacgacgtagcgttaaacgctctaaacgttgctgcttgtctaacacggctgggttagcgtaataagcggcttcgatttcctgatagtgagcgaccaatttacgcgattcttcaaccagttcagccagttgcagacggtaaggttctgccgattgtactgaacaagccatcaatttcgcactaaactcatcacgcacggttgggtgtgcggttggttgatcaaaccactcacctaaagcgctgcggccagcttgggttatagaataaaccttgcgatctggtttgccttcctgtggttccagaacacaagtcactaaaccctgttcccccattttattgagttcacgatatacctgctgatggctggctttccagaagtagccaatgctagcagaaaactctttggttatatcgtacccggttgcatcgcgtgtgctaagaacagtaaggataacgtgtggtaatgacatgtcttcaatccaaaaattaagtcaacataaacctctatctaaacggttgttgtgcttctaatggcactcatatcaacgcatttaaatacctgcagcgcaaaattcggctgcttatgtcaccttataaagccggttatcacctagagtggcgtatgtctttgcatactttaactgtgagattgctttacattacttatcacagagggaacgtagtatatctaaataataagcataaagtggaatacaaatatgctgattagtcgaaaaactgacattattctcaataatgaaaaaatgtaaaacaaaaggccacaaagttgtgaccttttagttttttatactgacatttagcgatttgttaaccagtattgcgcattcccgccgcaattcccgcaatggtcaccatcaaggcttcttccagttctggagcaggaagttctgattgacgggtacgatacagcagttctgcttgcagcatgttgagtggttcaatatagatgttacgcagacgaatcgactcttgtccccaaggatcgctttgcatcaggttctcgttattctcaacgttcagcacaactttaatgtcttgctgtaattgagcacgcaatttttcacccaatggacgcaaagtcggttcaacaagtcgctcatcataatgacacgcgatgcttacactgcatttggtgtacaccatttccagcatgccaaggcgagttgagaagaatggccattcgcggcacatctcttcaagtagcgcttggtgtccttcattaatggcaatttggatcgcttcacccgcacctagccaagcaggaagaatgagacgattctggctccatgagaagatccatggaatggctcgcaggctctcgactccaccagtaggattacgtttggcgggtctggaacccaatggcagcttgccgagttctaattctggtgtggcttgacggaagtaaggaacaaagtctggttcaccacgcacgacttttcggtaagcattacatgaaatttccgacagaatatccatcagcgcacgccactcatttttaggctctggtgggggtagtaagttggcttccaaaatagcgctggcgtacatgttaaagctgttgaccgccacttcaggtagacccagtttaaagcggatcatttcgccttgttcggttacacgcagaccgcccttcaaactctttggtggctgagaaagcagtgccgcgtgtgcaggagcaccgccgcgaccaattgtgccgccgcgaccatggaatagagtgagttcgatccccgcttcttcgccaactttcactagcgcttccatcgctcggtattgcgcccagcctgctgccatcacccccgcatctttggcggaatcggaataaccaatcatcaccatttggtggttctgaataaagccgcgatacagatcgatgttcatcagttgacggatcaccgattctgcattgttcaagtcatctaaggtttcaaacagcgggcaaacatccatacgataaggacatcctgcctcttgcagcagcaggtgcacggcgaggacatccgatgcggtacgcgccatcgaaatgacataagcgccaaaggcatctttggactgcgcagcgatgatcttacaggtatccaacacctctttgacttgaggcgacggttgccaatcgcgtggtagcagtgggcgtttcgagttcagctctgtggtcaggaacgcgattttatcttgctcgctccactgattgtaatcgccgatgccgagatgacgggtcagttccgagatcacttctgcatggcgtgagctctcttgacgaacatcgaggcgaaccagatgcacgccaaaggctttaatgcggcgcagggtatcgagcaaggaaccatctgcgattacgcccatgccacactcatgcagtgattggtaacacgcgtagagcggttcccacaactgatctgcggtttgcaaaggggcttttactgccagtttttggccgttgagttttgcatcaagaatttcaatcgtctcttgcagcaagcttcgtattggcttgaggatggcgcgataaggttcgtgctcttcgccggctaaagcgcgtacggcttcattacacttggtcatcgaaagttcgctgaccagttcattgatatcggtgagatacaaatcggctgctttccagcgtgacagtaacagcacttcgcgagtgatagtgtgggtcacaaaggggttaccatcgcgatctccacccatccaagatgagaaatgcacagggcgtgcatcaatcggtaaaccttcacctaggtaagatttcacctgttcatctaactcacgcaaaaactcaggaacggcgtgccacagtgagttttctacgaccgcgaacccccatttggcttcatctaatggcgttggacgctgctgacgaatcacatctgaatgccaactttgggcaattaattgctcaaggcggcgctcggttttatggcgctctttcggagagaggtcgctgagctcaagtttggacagacattcgttgattttgactagcttgttgatcatggtgcgacgagtgatctcagtcgggtgagcggtcaataccagttcaatgttgagatcgcgaatggcttgcgccgtatcgaatttactgaccgacttctgcgccagtttagcaaacaggctaccaatcgcatccaactcattcacgtggctttcacagtggcgtgagatggtgtgatactgctcggcaatattggtcaggttcaggaattggttaaaggcgcgagccacgggagtcagttggtggttaggaagatttttgatctcttcgatcagcagctcgcggtctgcttggttgcccgctcgggcagatttggaaagttttcggatggtttccactttcgctaaaataacgtcaccatcggcggcttgaattgtctggccgagtagtcgtcctaacatgcttacgttacttttgagcgcagcgtatttttcgttcattgtcatcctgccttgaaaaaaaattacatccaatgtgagttcagttaattacacaatcttgaccattttgtccagtggacttgcggttaagactaagattccatttattgtcatccgcgttggtgcagagattgtttaactaaaaacaccaaattattgaaaatttcttacaaaaaagccctgaggttgaactcagggcgatcaatttagaaacaatatttctgcatggctcgtgatagcacgcgtaccgttgggtcaataaattcaaacgccaaaaactcatccggctgatgagcttgatcgatcgaaccagggccaagcactaaggtcgggcaaacttgctgcaagaaaggggcttcggtgcagtaattcacggtttgcgcttcttgctcgcagatttcgctaataccgtgaataaacggatggtcatgcgcgcactcataaccggggatcgggtcatgcagcgggacgagttcaatgcgccccggccacttttgctgtacctcacgtagagcgtcatgcatcaggttatctaaaccatctaagctaatgcctggaagagggcgaacgtcataatgcagttcgcagcaaccacaaattcggtttgggctatcgccaccatgaatgtgaccaaggttcagcgttggagtcggaatttcaaatcccggatggtgatattctttaattaagcgatcgcgcagctgcataagagcaaacagcacttcgtgcatgatctcaatcgcattaacccccagcgctggattggatgaatggccagatttaccggtcacgcgaatggcattcgccacatggcctttgtgcgcgcggatcggcaccaagctggtgggttcaccgatgatgcagtaatccggtttaaatggggcgttttcggtaaagtggcgtgcaccgagcatggtagtttcttcatcgcaggtcgccagcacatacagcggcttggtttgtttgctccaatcgacgtttttcaccgcttcataaataaaggcgaagaaacctttcatatccgcggtccctaatccatagaagcgattattgacttgcgtgagcgcatgcgggttgtaattccagcgaccctcatcaaacggcacagtatcactgtgtcctgctaataataagccgccttcaccgctaccgagtttggcaatcaagttctgcttattcggggcgacttgctcaatttgaatcgaaaaaccgagcgcgctgagccaatcggctaattttgcgatcacctgctcattaccttcatcccagcgcgcatcggtcgaactgattgaagaggttgaaatcaggccttcatagacctcaaggaaactgggtaacggcattttatctttgctcctgctattgacagagtgtcggtgaaacggtaaaacacatattaaatcactttaagtgaataaaaaaacaattaatcgcaattttgaaagatgaatagtcagcgttgttcgctctctttcaccacttaatacggatgtttttgatgttaaaaaccaccatcatcggcgcaagcggttacaccggagcagaactggctcttatggtgcacaaacacccacaactcacgctatcaggtttatacgtttccgccaacagtgtggatgcgggcaaatcgctggcgcagttgcatggtcgagtggcagggctgattgatatgccagtgcaagccttgactgatgtggatactgttgcggccgagtgtgatgtggtctttctggccaccgcgcatgaagtgagtcatgacctcgcgccgcaatttctcgctcaaggttgtcaggtctttgatctgtctggtgcatttcgggtgcagagcgaagcgttttatccaaccttttatggctttgcgcatcagcattctgaatggttggaaaaagcggtgtatggcctggctgagtggaatgcggaagcaatcaaaaccagccctatgattgctgttgcgggttgctacccaacggcatcgcaactggcgattaagcctctgttggtggatgggttaatcgacactacccaatggccagtgattaacgcggtgagtggtgtctctggtgcggggcgtaaagccaccatgaccaacagcttctgtgaagtgagcttgcagccctacggtgtgtttaaccaccgtcatcaaccagaaattgcgactcatctaggctgtgaggtgatcttcaccccgcatcttggcaactttaagcgcgggattctggccaccatcacaatgaaattagcggatggtgtcaccgagcagcaagtcgcagaagcttttagcaaggcgtatcaagataagccattggtgcgtttcagcaatggtttaccacggattcaagatgtcgagtttaccccattttgtgacctcggctggaaggtacaaggacgtcacatcatagtggtgtctgctatcgacaatttattgaaaggcgcatcgagtcaagcgatgcagtgtttaaatattcactacggtttcgatgaattaaccgcgttggtgtaagggttcaacatgtcagatcttaagctcagtcctttagtgattaagttaggcggtgcggcgctcgattgcgcagagacacttagcaaattgtttggtgcgattgcccaataccagaaccaagcccaacgacgcatcgtgatcgtgcatggcggtggttatctggtcgacgacttgatggcgaagctgcaactcaaatcggtcaagaaagacggtttgcgcgtcactccgtatgatcaaattccgatcattgccggcgctctcgcaggtacagccaacaagatgctgcaaggccaagcgatcaaagatggcatcaatgccgtaggtttgtcactggcggatggtggtttgtgccacgtcgaggaattagatcctgaactgggcgcagtcggtaaagccacgccgggagattccactttgctgcaagcgattttggctaccggtgcgatgcccatcattagctcgattggcctaactgcgcaagggcagatgatgaacgtcaacgctgatcaagcggcggtggctgtggcgggtgctctggatgcggaattggtcctgctctcggatgtcagcggtgtactggatggcaaaggccacctcatcgccaccttagatgctaaacaagcggatgcactgattgccggcaaagtgattaccgacggcatgatcgtcaaagtgaaagcggcattggaagcggcgcaagatttaggacgtccgattgaagtggctacctggcgttacccagagaagctcgccaagttatttggcggcgaaagcatcggcacccgttttctaccttaagattttaagtcactaatttgattaaacctgagcactgaccgccaagcgcagagccaggaatatggagatacatcaatgagtaaagtacaagttaaaaaagtagttgtggcatattctggcggtctggacacgtcggtgatcattccatggttaaaagaaaattatgactgtgaagtggtggcgtttgtggctgacgttggtcaaggtgatgaagagctgaaaggcgtagaagccaaagcactctcatcgggtgcctctgaatgttacatcgttgacctgaaagaagaattcgtaaaagagtacatctacccaacgctgaaaactggcgcttactatgaaggtaaatacttactcggtacttccatggcgcgtccggtgattgctaaagcacaagttgaaatcgcgcgtaaagtgggtgcggatgcactggcgcacggttgtactggcaaaggtaacgaccaagtgcgttttgaaggtgcttttgcggcactggctccagatctgcatgtgattgcgccttggcgtgagtgggatctgcgtagccgtgaagcgtgtttggattaccttgccgagcgcaacattccctgtgccgcgtcattaaccaagatctactcgcgtgatgccaacgcatggcacgtttctaccgaaggtggcgttctggaaagcacatggaatgcgccaaacgaagattgctgggtgtggaccgtcgatcctgagcaagcgcctaacgaagcggaatatgtcacgctgcaagtggctcatggcgaagtggtcgctgttgatggtgaagccatgaccccttacaacgctttgctgtacctcaaccaaaaaggtgcaaagcatggtgtaggtcgtatcgacatcgtggaaaaccgtttggtgggtatgaaatctcgcggctgctacgaaaccccgggaggcaccatcatcatggaagcgctgcgcgcggttgagcaactggtgctggataaaacctcattcgaattccgtgaagagctgggtattaaagcgtcacaccttgtttatgatggtcgttggttcacgccactacgtcaggcggtatttgcggcagccgatgagctagcgaaagatgtcaacggtgaagtggtgattaaactgtataaaggccaagccgttgcaacgcaaaaacgttcggctaacagcctctactcagaagatttcgcgacctttggtgccgatgaagtgtatgaccacagccacgcaggcggcttcatccgtctctattcgctgtcaagccgcatccgcgctctgagccaaaacaagcagtaatcagcgcagtcatcggtttatataataaggatcgcactgcgatccttatccccttcctaattgaagttgcagcggtgttggctacgttcattcaccccaatcacatagtttatctatgctcatggggattcactcacttgccgcctacctgccactccatgagtttgggggacattttcagttatcacatcctcgacggcggttgcggtgagaggaaaacaggagattaagcatggcattatggggcggaagatttacccaagcggcagacagtcggttcaaatcattcaacgattccttacgttttgattatcgattggctgagcaagatattgttggatcaatcgcttggtcaaaagccttggtctccgtcaatgtcttgagcgtgcaggagcaacaacagttagagcaggcgttaaatcacctattgcaatcggttcagcaagatccggagcaaatcttagcctctgatgcagaagatattcactcttgggtcgagcagaagctgattgagcaagtcggtgatcttggtaaaaaactgcacacagggcgttcacgtaatgatcaggtcgcaaccgatcttaagctctggtgtcgcgatcagggcgttcatctgctgcttgctctgaaaacgctgcaacaacagttggtggcggtggctgctgaacatcaatcgacagttttgccgggctacacccatttgcaacgcgcgcaaccagtaacttttactcattggtgtttagcttatttggagatgtttgagcgtgatgagtcccgtttgactgatgctctagcgcgtttaaacacctcaccactgggttcaggtgcattagcgggaaccgcttacgcgattgatcgtgaggtgttagcggcggatcttggtttcactcgcgcaacacgtaactcgctggatgcggtctccgatcgcgatcatgtgatggagctgatgtcagtcgcatcgatctctatgctgcatttgtcgcgtctggcggaagatatgatcttctacaccactggtgaagcgggctttattgaattggctgatacggtgacctctggttcttcactgatgccacaaaagaaaaaccccgatgcacttgaattgatccgcggcaaaaccggacgcgtctatggtgcattggctgggatgatgatgacagtcaaagctctgcctctcgcgtacaacaaagacatgcaagaagacaaagaagggctgtttgatgcgctcgacacttggtttgattgcttgcaaatggcgggactttgctttgatggcattaaagtcaatgcggcgcgtacgttagaagcggccaagcaaggctactcgaacgcgactgaattggcggattatctggttgcgaaaggcattccatttcgcgaggcgcaccatattgtcggggtagcggtagtcgcagctattggcaagggtgtagcgttggaagagttgtgtctggcggagctgcaacagttttcgcctttgattgagcaggatgtctatccgatcctgactattgagtcttgtttagagaaacgctgcgcactcggtggggtatcgcccaaacaagtggcgcatgctcttcagcaagctcaagcgcgcgtgaagtcttaacatttcagcgagctggtcgatcctatgagataaatggaaaaaaacagtggtgcaactatttgagtaataagaggaatcatctcggagaaaaaagatcgtaaaaaagatcatttttttatgaaccttttgcttagagctctgtctattactgtaccactgctttttcttagaagactctaagaaggccctaaatctgtactaggtttagggcttttttcttttctgcgtagcagaaagtttaattcgggttctaatcctcttttccttgtcgtttacgccaaggcaagatcacatactttatccataaatgcagaaacagtaagccgttaaaggcaaaccccgcaaggatcaagctgatcgactcgatgctggcgggatcctctttaaagccccaaaaccaaatgatccacacgacaacggacaacaccgtgagttgatccatacagcgttgacagcgaccaatttttttccaaaaccaatgttcgctacactctccacaagccatacgcttcaccttaagccaaaagatgtgattatcagtcggtgaacaacaccgagttgctaaaacatcaaggagtataactcagcgcaagtatgatgccgaagcttgagtgcagagttaagggcagtgagaattgaatgagctcaacagcaaattcaatctaatccaaaaaagcctgaggttgatctcaggctttggcatttttacagaaagaatcggttctgagtgcgcgggaaattaacagcccggaccacaatccaaacagtgtttgatcatctcagggcctaagtgcagcttcgcgtttaaatcacgcagagcagtgcgtaccccttcctcaatcaccggatggtagaaaggcatatcgagcatctgcgaaatggtcatctggttttgatgcgcccaagccagcaagtgtgctaaatgctcagcattcggtcccatcatctccgcaccaaggaaacggccagtgccttgctcgccatacacatgcagcaagcctttgttgcgcagcatcacacgtgaacggccttggttttcaaacgacacttcacccacggcaaagcagccacagttacccagacgctgagtcagctgcttataggtttccccgaccatagcgatttgtggatcagaaaacaccgcagaaattggcgagcggcgtaaacccgcgcgaatgtcagggaagcggcctgcgttatcgccggcaatgcgtccttgatctgcggcttcatgcagcagcgggatttggttgctggcatcgcctgcaataaagattgaaggtaccgaggtttgcaatgtgtagtgatctgctttgggtacaccacgctcatccagtgccacatcggtattgtccagtgcgagcttatcaacgttgggacgacgacctgttgcggcaagtacataatctacgatgaaggtttctagctctccttgttggttgataaattggatttccactttatcgccagcaatacgtttcatgctttcgactttgacgtctgcatcaagataaaactcttgttggaaagcacgattcgcgtaagccatgacgtcaggatcagtgagtggtcctacttgaccgcctaagccaaacactttcacttttacccctaaacgatgcagggattggccaagctctaaaccgatcacacccggaccaaacaccgcgacggcttgtggcaggtcatcccactcaaatacgtcatcattgaccacaaggcgatcgccgagctcattccatactgctggataagcagggcgagaacccgtcgcaatcacgatacgtttggcatgaatacgcgtgtgatcatccacttgcagcgtatggttatcaataaacttggcgtagcctgtaatcttgtcttgttcaggaatggaatccaccccttccagcacaaaaccgacaaagcgatctcgttcgcgtttgacgcgatccattacttcacgtccattaatcacaatttcaccttgcgggtaaaccccaaagccgggcgctttttcaatctggtgtacactttctgccgcggcgatcagcagtttggaaggcatacaacccactcgcgcacaggtggtgccgtaagggccgccttcaatcatcaccacattcggagtgtaagctttcgctgcacgataagcgccaaggccagcagtaccaccgccaattacggcgacatcaacgtgaatctgtttcattatggatcctcaatcggtttgttctcagtctgaaagggcagttttaggctcccggatggaagcctagaaacttattgatttaggtagacttctaagtcgtcgctaccaccaatgtgtttaccaccgataaacacttgcggcaccgtggtacggccagaaacggcgcgcagactcactgtggtagcgtctttacctaaaatcagctcttcatactgtagaccggcatcaatcagcgcttgtttcgccttggcgcaataaggacagcctggcttagtgaaaatagtcactgattcttgcaccttgtattgaggggcaatgtatttgagcatggtatcggcgtccgatactttgaacgggtcgcccggctcattcggttcgataaacattttttctaccacaccgtctttaaccagcatgctgtagcgccatgagcgtttaccaaagccaaggtcatttttatccaccagcatgcccataccatcggtaaattcaccattaccatcaggaatgaaggtgatgttgtcggcattttggtcatctttccaagcattcatcacgaaagtatcgttgaccgatacgcacagaatgctgtcgacaccatgctctttaaagacaggaaacagctcgttgtagcgcggtaggtgagtggatgaacaggttggagtaaaggcacccggcaagctaaacacgataacggttttgcctttgaacagttcatcgctagtcacattgacccaagcgtcaccttggcgagtaggaaaagtaacctgtggaatggtttgaccttctttagatgtaaacattgtgttcctcatttgtgaaatttaattttaaatcaataggatgtgtttcgttgttgatggctattgttaaagaaaagctttgatagctctaatcgtttaatgctatggttttaatagatgcattctatctggggaagctatgaacattcgtgattttgaatacttggtcgcattagctgaccacaagcatttccgtaaagcggcagaagcgtgctttgtcagccaacccaccttgagtggccagatccgtaagttggaagatgaaattggaacgactttgcttgagcgcagcagtcgtcgagttctgtttaccgaagcggggctacaactggttgatcaggcaaagaaaatcctttcggaagtgaaaacgtttaaagatatggctaaccagcaaaccggagccatgactgggccgttgcacatcggctttattccgaccttagggccgtatttactgccgaagatcattcctactttgaaagaacgtttccctgaattggagctgtatctgcatgaagcgcagactaaccagttagtgcgtcagctcgaagagggcaaactggattgcttggtgctcgcttcggtggaagagacggcaccttttaaagaaattgagctgtataacgaagtgttgagcattgcagtgccttgcgatcatgcttgggcggcgcgtgacgaagtggacatgctggagctgaaaggtaagaccgtattggctttaggagatgggcattgcctgcgcgatcaagcgttaggtttttgctttgctgcgggagcgaaagatgatgaacgctttaaagccaccagtttagaaacgttgcgcaatatggtggctgcaggcgcggggatcaccttattgcctgagctagccttacctgaagataaaaccaaagatggggtttgttacctgcgggcggttaacccgattccatcgcgtcgactcgtcttggcttatcgaccaggctcgcctttacgccagcggtttgagcagttggcagaagtgattaaacatcgcttacagcaaagcgagtaagacggcgaatcgaatacaaaaaagaggctgatgattcagcctctttttattcggttttctgtaccagagtttactagaacagctcttcaccagagctggtcgaatagatggactcattgacatgttcgctgacgtactctgtcggctcagtgccggcttcgaaatactcaaacatcgagctggagtcgagtttgttggtcagtaaccccgtatcgcggtcaatgcgaacacgagcgatattgttcggtaccgctttctgttgaacgggcacatcttgtagcgcgagagacataaactcaacccaagctggcaaggcggttttaccacccgattcggcaccggaaacatcatcttcaatgtttctattcggcgctgttttccctaggttacggctatgatcatcaaagcccacccaagccacaccaacgatgcctggggcataaccgttgtaccatgcatcttttgagtcgttggtggtaccggttttaccaccgatgtcgcggcgtttcagtgcctgtgctcgccagcctgtaccgttccaaccggtatctgagctccactcaccgccaccccaaatattgctgtacagcatttcacgcgttaagaaagcgttttgctcggaaatcactttcggggcataagggcttgctgcgtcttgctcggcaaactcatcaagttccgatgagcattcacggtggcagacgactttcggctctgcgctaaactcaatgttgccaaatggattttcgacgcggctgatgtagaaaggttcaacgaagtaaccattgttagcaaaaaccgagaagccttgtgccatttgtacaggagtcaagctgcctgcaccgagcgcaatcgtctcagagcgcggtaactgatctaatttgaaaccaaagcgagttaagtattcgcgtgtttcatccaaacccacttcacgcaaaacgcgcacggccatgacgtttttcgattgggctaaaccaattctcagtcgtgttgggccggtgtaggttggtggtgagttcttcggacgccatgccgtgccttgactctcatcccattggttaatcggcgcatcattaatcagcgtggctaaagtgagtcctttattcagtgccgcagaatagataaatggtttgatacttgaacccacttgacgcactgactgggtagctcggttaaatttgttgtgcacaaagttaaaaccaccaaccaacgcagtgaccgcgccgttttctggattcatcgcgacaaatgcggtgttggcattcggaacttgagttagcttccaagcggtaatcgcgccatcttgggtgcgtggacgaacccaaatttgctgtcctgcggctaaaaattcattggcacttttcggaagtgggccttggcgatcgtcgttgataaaacggcgcgcccaattcatgtcttcccaagcgatggtttgcacaccatagctttttacccacacttgggccgatttttcttcaacgctgagaaccgcggcagggaacatatcgccataggtaggttcattgctcaggtattcagacagctgagtgctgctccaagccggttgattgacttgccacaactctttttctgcaccgcgataaccgtgacgctcatcgtaagccaacaggttattgatcgcggcttggttggcggctctttgcaacttagagtcgaccgttgtgtagacattcatgcctgacgtgtaagcagcttcttcaccgtagcgttcaaccatccatgcgcgagcaatttcagccacatacggtgcgtttaactcaatctctgcgccatggtatttcggcagcacaggttcggcacgcgcagcatcgtattctgctttagtgatgtatttttcatccagcatacgctgcagcaccacattacgacggttggtcgcacgctcgacggaatagatagggttcatggttgaaggggcttttggtaggcctgcaatcagcgcaatttcacctaaggtcagatctttcacctctttgccgaaatacgcttgcgcagccgcgccgacgccataagaacggtagccgaggtaaattttgttgagatacagctctaagatctcttgcttgcttaacagttgctcaatatggatcgcaatgaagatctctttgactttacgcatcaccttcttctcattagagaggaaaaagttacgcgcaagctgctgagtaatggtactggcaccttgcgaagcactgcccgaggcgagtacagcaaaggcggcacgcgtgataccaatcgggtcaaaaccgtagtgctcgtagtagcgagagtcttcggtcgcaatcaccgcttcgatcaactctttaggcatttcttccagcttgagcgggatgcggcgcttttcaccaaattgggcgatcagtttgccgtcttgactgaagacttgcatcggagtttgtaattggacatcacgtagagtggctacatctggcagatctgatttcacataaaaatagaaaccaaagattgtagtgactccaagaataatgcaaatcaatgaaaatactaataaacgctttatgaacttcaccggagaatccctgtttagttgaggctgcactaatgcaaacccttgtactctaggctaaaaccttagctcgcaaaatatcatctgcctatttattgagaaaataggtctatcgagctgaacctctttactggagcttagcctcatgggtaaatcattagttacgggtattgatatcggccaccacagcattaaagctgcggtgctcaaacctatgggcgacacttatgcgcttgtggggtatgaggagttgctcgttaccgctgatattttcaccgataatcacacgctcgattatcagaaaattgtaaagaaactaaaagaactaaaaaagggtttgcctctatttagtcataaagtcgcgatagcaatcccggatagcgccgtgattagcaaagtattacaaatagatagcgatcttgagcagcgcgagctggaatttgctgtctatcaagccttttcgcatcaatctccattccccgttgaagagctgagcctcgatttcgtcaaagtgacggaaaaaagcctcgcccgcagcagcacgacgaccttccaagtgtatgccaccaaaaaagacgtggtcgacagtcgtttgcatgccgttaaaaaagcgggttttgaaccagtgttgatggatgtgcaagtacatagtttgttgcatttatggcaactcgctagccgtgcgtatcgacgtccagactggatgttggtggatattggctacacccaaagttcattgtgcctcgattttccggaaaaaatgcccttttacaaagacgtgccattaggaactcgtcaattggaatcagaacccagtgctgtgaactcattgaatcatccactgttacacgatcccacgcagcggtttattcaagaattggtcgacaaaattgcgcggcaaatccagctttttacttcggtgcacgggactcaaagtcttggcgggttatggctatcgggtggcggtgccacgctttctggtttagaggacgcgctttatcaacgcttgtcactgccttgcgaagtgctcaatccgttttcactgttcaaaaacaatgtggcaaaacgcaaacgcccactggttgatggccagcgttttagtaccgccgccggtcttgcattgcgaggcttagcttggttggagagtgagcatgttgcataaggtcaacttactgccgtggcgtgatgcacggcgtgaagcacataagcggcgctttttggggttagtgacactcggtgttttgctggcggtgttgatgcaatttgcagcaggcgaatacttgggcggacaaatggctttgcaacaagagcggattggttatttgcaacaacatatcttctcgctggatcagcagatcgctaagttgaagatcgctgaagaagaacataaggcgttattgacccgtttgactgtggtggagcaactgcagcaaaagcgcaataaaacgactgagtttatgaaccaaatgcccaacctgatccctgaaggcgtctatgtcgacaagatcaagatgaatggccatcagatagaaataaccgggattagcgattccaccgctcgcttggcaaccatgctcgataacttggagaagtcggacaaattaaccgatgttgaaatgcatgaaatcgtttcagggaataagcgatttggtaagcaatttcagagctttaaagtctccttccaaattttaaccccagcctctaacccgcaagcgggaggtgcacacaatggctagtctacaagagctagaactggatgaaattagtgaatggccgctgctgcctcagttggtggtgattctgcttatcatgctactgatccaaggtgctggttattggttctatctcatgcccaaacaagacgagattgcgctgttaaagcaggaagaggaaaccgtcaaggcgacactgcgcatcaaagccaataaagtggcggtattgccgcagatccaagctcagttggacgagctcaaagagcgttacgattttttactgcgccagctaccggtgcaaaaagagttagccagcatgctggcgtcagtcaaccagcttgggctcgatagttcgcttacctttacgcggattgattggggggagcgtgaaagccaagagtttctttaccgcttaccgctcaatatcgaactgacggggagctatcacgatattggcgatttttcgcaagcgattgccaagttaccgcgcatcatcaacttcgacgatgtggactggcagcgtgtcagccaagagagtagcacgctgcactttcgagtcagagcctacacctaccaatttaagcaggaggtggatgatgaaaaataagccacttggattatggctgatgagtttgctggtgttggtcgggtgtaaggcgaaccaagatgatttgacctcatacgtcgcgcaagttgagcgtgaagcgcgcaaagaagtaactaagctcaaacccattttagagtttgaagccacgccctatcagcagcacaaggggcgtgagccgtttgtcttaccgaaagaagcgttagtgcaaaaccaaccgctggccaaagccgactgttggcaacccgtgccacgtgcgaaaaatgggccgttggagcgttatccattgcaccaattgcgcttaaaaggggtgatgagcagcgggggcagtatctctgccttagtgcaaacgccggcagggagtgtggtcaaggttaaggcgggtcaatatgtcggaatcaataatggcaaagtcacccgagtcgacgacaactatttgttaattaatgaaactttgcctgatggcttagggtgttggaatcagcgtaacgtcaagctggctttaaaataatcggttgaagtatagagatataacgatgaaaaatggattgaaaacttatgtcgcacagacttggctgaccttgtgggttggtttggcactttgtgcttcttccatggtgtttagtgctgaatccgctaccgccaaccagttggaaaacatcgactttcgggtcaacaaagagaaggcggcggtcttaattgtcgaattggcttcgccatcggcggtcgtggatgtgcaaaaagtccaagaagggttgagcattgaactcctgaaaaccgatgtggcggatgacaagctgtatctgcttgatgtgaaagatttttcgacccctgttgagagcgtggaagtattccgtaaagagccaagcacacaactggttgtgactgtcgatggggagtttcagcacgattataccttaaaaggaaaataccttgaggtcgtgatcagtaaactcaaagccgatgaaaagcctaagcccaagagtgtcttggaaaaagaaggcaagctgatttcaattaacttccaagatattccggtgcgtaacgtactgcagctgattgccgattataacggtttcaacttagtggtttccgattcggtggtgggtaacctgactttacgcttggatggcgtgccttggcagcaagtgttggacattattctgcaagtcaaagggctcgataaacgggtcgatggtaatgtgattttgattgcgccgaaagaggaactcgacttgcgcgagaaacaagcgctcgaaaaagcccgtttagcagaagagttgggcgatttaaaatcagaaatcatcaagattaactttgccaaagcgtctgacattgcggcgatgatcggcggtgaaggcaacgttaacatgttgtctgaacgaggttcgatcagcatcgacgaacgaactaactcgctattgatccgagagctgcccgataatattgctgtgatccgcgagatcattgaatcgctggatattccggtcaaacaagttcaaatcgaagcgcggattgtcaccgtcaaagaaggtaacttggaggagctgggggtacgctggggcgtgatgtcgaccaatggtagccactcggtcggaggaagcatagagagtaacttatggcaaaaagggttattggcggatgatgaatttccggtggatgaattcttaaatgtgaatttggcttccacctctgccaatgcgtcttcgattgctttccaagtcgctaaattgggctcaggtacgttgttggatttggagctttcagcattacaaaatgaatcgaaggccgaaatcatctctagccctcgtttgattaccactaataaacagcctgcctatattgagcaaggtactgagatcccttatctggaatcgtcttccagtggtgcctctacggtcgcgtttaaaaaagcggtattaagcttgaaggtgacaccacaaatcaccccagataaccgcttggtgctcgacttgagtgtgacccaagaccgacgcggtgaaacggtgaaaaccggtacgggtgaagcggtatcgatcgatactcagcgtattggcactcaagtgttggtgaataacggagaaactgtggtgttgggtggcattttccaacacagcatcaataattcggtagataaggtgccactgctgggggacttgcctgttttgggggcgttattcagacgaacctatgagcaaatgggcaaaagtgaactgctgatttttgtcacgccgaaagtggtcattcaataacttagcgtgtgcgtaacaagcgaacaaaaattaaagttgcaatagtggcaccatatctagataatttcgggtcttatcacgaaatatcggtgaggaataggtgccacaagcattcctatggttggcgtatgtccagcaactcttgtggcgatgtcattgaattaacgttgtaaattactgctgaacatggctgagaaacgcaatattttccttgttggccctatgggcgctggcaaaagcacaattggtagacacctagctcaacaactgcacatggagtttatcgactctgatacggttatcgaagaacgtaccggagcggatatcgcatgggtgtttgatgttgaaggtgaagaaggcttccgcaagcgcgaagaagccgttattaatgatctaaccgagcaacagggtatcgtactggcgacgggtggtggctcagtaattagtaaagagaaccgcaaccgactgtctgctcgcggtatcgttgtatacctcgaaactactatcgaaaaacaattagcacgtaccaatcgcgataaaaagcgcccactgctgcaaacggattgcccgcgtgaagtgctagagcaattggctgaagatcgtaatcctctgtacgaagagattgcggacatcacggtacgcactgacgatcaaagtgcaaaagtggtagccaatcagatcgtaaaaatgctagaagaacacataatgtaatgtttcttcgaattggagtgcaaaaccatggagcggattacggtcaacttaggtgaacgtagctacccaatctcaatcggtgccggattgtttgccaatccggctcttctttccctctctgctaagcagaaggtggtgatagtcaccaaccacactgtcgctccgctgtatgcgcctgcgatcatttcattacttgatcacatcggttgccagcatgctttgctggaactgcccgatggcgaacagtacaaaactctcgaaaccttcaacactgtgatgagctttttgcttgagcataactacagccgtgatgtggttgtcattgctttaggtgggggagtgattggtgatctggtcggtttcgcggcggcttgttatcagcgtggcgttgatttcattcaaataccgaccacactgctgtcgcaggtggattcttcggtcggtgggaaaaccgcggtcaatcatccgctcggtaaaaacatgattggtgctttttatcaacccaaagcggtagtgattgatacggactgtttgactacactgcccgcccgtgaatttgccgctggcatggcggaagtcatcaagtacggcatcatttacgactcagccttcttcgactggctagaagcacagatggaggccttgtacgcattggacgaacaagcgctcacttacgcaattgcgcgctgctgccaaatcaaagccgaggtggtcgcgcaagatgagaaagagtcgggcattcgtgcgttactcaatcttggtcacaccttcggccatgcaattgaagcacacatgggctatggcaattggctgcacggtgaagccgtatctgcgggtacagtaatggcggcgaaaacggctcaattacaaggccttatcgatgcatctcaatttgaacgtatcctagctatactgaaaaaagcgcatttgcctgtgcgaaccccagagaacatgacctttgccgatttcatgcagcacatgatgcgcgataaaaaagtgttggcaggggaactgcgtttggtgttaccgaccagtatcggcacgtcagcggtcgtaaaaggggtacctgaagccgtgattgcccaagcgatagagtattgtcgcacggtgtaatcgagagacttgcagaacattttgatatcagacaattgtcattaggatggcccaatgagcttggcacatgaactggatttagaatcgcaaactgagttactggaacggctgcaactgctgacccgttttggttctaacttggtgaatgtttgtggtcgccaaggggcggggaaatcgtggctcgcgcaacgatttttagacagttgggcgcaagataaaaaccaatctttgctcatgtgccatcctaaccaaagtgacgagcagcgtcgcgtgacgatgttgtcacagctgttttctgagccactttacaattccaaagacgccttagcggaaagcttcgcgcgtctatttgaagatcaaaattgcgatatcgtgattgtggtcgatgatgcccatttactctctgagtctttggtttccgaattgtggatgttggtactcgaagcacaaaccaatccacgctggaacgtcaatgtggtgctgtttgctcaagacaatggtctggatgcgttattaacgcgtttaagttatgggcaagaacataagcctgtcgatttagaaattgagatgctctccgaagatgaagcagatcgtttattcgaaaatcgcgtcatgcgctatgttgatccacaagttgagcgtaaagtgcgtaatgcttataagaagatcaatccgttaccgggggaaattatggcgttggcggaaacgaaaaatgaaaaacgggtggtgatccgctcgattgttggctctccgtttaatattgccttggtcgtattacttctcttgttgttgctgggcggaggttattggtggctgctgtctaagcctgttccacaagagggtagcctgcttgaaggcgaggtcgcagaacaaaccgcgattccaaccctcaactccgaagcaaaccctctagctcaagacggtacctcaagcgcaaatggcgatggcatttctgatgctgaaggcgataactttggtgccgacgatgatacctctgctttgccaccggatgtggtggataccacagccagtgtcggcattgccgatgacggtaagcgcgtcgtgatcaactctgatgtggtggatgccctgctgcaaggcaaagcagacaccgctgatacttcggcgatcaacaacttagtagagtcaactcaagcggcgacggagctgaaaacgcaaacgttagagcaaacacaagtgcagaatgctcagcctaaatcggtgagtttctcttttgcgcgtgatgagctgaaagccatgtcaccacgcagctacacattgcagttggcggcgatgaattctctgcaagatgtgcaaggctttatcgacgagcacaagctacaagggaaagtctacgtttacccaacactgcgtaacgatgtcgagtggtttattgtcactatgggcaactatcccaccatccaaatggcgcgtgatgcctcagaaaaactctctgcttcgctacaagcgttaggtccttgggctaaatcacttagccaagttcagcgagaaatcgagcgtaagaaataaacctgagcttcgctgaaaaatatgttacattccgcagccttattttgtggccaacgattagagcagtagatgaaaaagcagcgcgcctttctgaaatgggctgggggtaaatatagcctagtcgaggatattcaacgccatctaccagaagctcgtgagctggttgagcctttcgttggtgcaggctcggtcttcctgaatacggattttgaacgctatctgctggcggacatcaatccggatctgatcaatttctacaatctgctcaaaaccgaacctcaagcttacattcacgaagctaagcgttggtttgtgcccgaaaataaccgcaaagaagtctacctcgatattcgtaagcagtttaaccagagtgacgatgcgatgtttcgctcgttggcgtttttgtatatgaaccgctttgggtttaacggcctatgtcgttataacaaaaaagggggctttaatgtgccgtttggctcgtacaaaaagccttatttccctgagcaagagttagagttttttgctgaaaaagcgcagcgtgccacctttatttgcgcgtcgtatggcgaaaccttcgctcgcgcgcaaagcgatagcgtgatttattgcgatccaccttacgcaccgctgtcgactacggccaattttacctcttatgcgggcaatggttttaccttagacgatcaagctgcgttagccgatatcgccgagaaaaccgccaaagagcgtggaatttcggtgctgatttccaatcacgacaccacccatactcgccgtttgtatcgcggtgcgcagctcaatgtggtcaaagctaaccgtaccatcagtcgtaatggtgccggacgcaataaagtggatgagcttttagcactcttcacgcctcatctttcatcgcaagcgtgatcttgtgggctgaatggtggatttcctctccctgcctcaagtcacgcgctaggatctcgtcaccagcttaggtagaatggcggccacattgtgttcagcttgcattcaattcctaacgaggtcggtatgaaagattttctcattgcaccatccattctctccgctgattttgcccgtctgggcgaagatgttgccaaagtgctcgccgcaggagcggatgtggtgcatttcgatgtgatggacaatcactacgtaccgaacctgacgtttggcgcgccgatttgtaaagctctgcgcgattacggcattacggcaccgattgatgtgcatttgatggtgaaaccggtggatcgcatcattccggactttgccaaagctggcgcctccatgatcactttccacgttgaagcctcagagcacgttgaccgcactttgcagctcatcaaagagtgcggctgtcaggcgggcgtggtactgaacccagcgacacctctgcaccatctcgattacatcatggataaagtcgatttgattttgctgatgtcggtgaacccaggctttggcggacaatctttcattccacatactttagataaactgcgcgcggtgcgtgaacgtatcaagcaaagtgggcgtccaattcgtttggaaattgatggtggtgtgaaagtggagaatatccgcgaaatcgcggaagcgggtgccgatatgtttgtggcaggctcggcgatttttggtcagcctgattaccaagcggtgattgagcagatgcgtgctgaactggcgaaagccaaaatttaatctgatttaggatcgtgttttgaaatccataaaattaattgcttttgatttggatggtacgctgctcgacagtgtgccggatttagcggtagcggcggatcaagcggcgcgtgcggtcggctatccggcggtgagcgaagcgcaggtgcgtgattatgtcggcaacggtgcagatgtgttgattgcgcgcgcactcagccagagcttaacgatcaatcctgaattaagcccagagctacgtgctcaagcgcgtcatctgtttgatgagttttatgaacaaacggggcacaagctgagccacctgtatcctaatgttaaaaccacgcttttagagctgcatcaagcgggctttattctggcgctcgtgaccaataagccttctaaatttgtgccagatgttctagagcaacacggcatcgcgcactttttcagtgatgtgattggcggcgataccttcccgaataaaaagccggatccgatggcgctgaattggttattagagaagcatcagttaagcgctgagcaaatgttgatggtcggggattcgaaaaacgacattctggcggcaaaaaatgctgggtgttattccttcggtttaacctacggttataaccacggcgaaccgattgccaatgcggagccagacttcgtctccgatgatattggcacgctgcttgaagtggtgctcgtttcggcgtaaaagttgccgttcgcactagtaaaatactcgttaatgagtacactgcttgaaccgcgccgattccgtgcgcggtttttgtccctttgttttgtgtaatttcaatttcagtcacaaggaaatcaaacccatgagcaaacccattgtattgagtggtgttcaaccgtcaggtgaactaagtatcggtaactacttgggtgctctacgtcaatggcaacagatgcaagatgattatgactgccagtactgtgttgtggatttgcatgcaattacggttcgccaagatccgcaagcactgcatgaagcgacattagatgctttggctatttgtctcgccgttggcgttgatccgaaaaagagcacgctatttgttcagtcacacgtacctgagcatgctcaactcggttgggttttgaactgctacacccagatgggtgagctgagccgcatgactcaattcaaagacaaatcagcacgttacgccaacgatgtgaatgctggtctgtttggttatccggtactgatggcggcagatattctgctgtatggcgcgcaccaagtgccagtgggcagcgatcagaaacaacatctggaattggcacgcgatatcgcgacccgtttcaacaatatctacagcccagaacagccgatttttaccattcctgagccttacatcccaaccgtgaatgcgcgggtaatgagtctgcaagatgcgactaagaaaatgtccaaatcagacgataaccgcaaaaacgtgatcaccttgttggaagatccgaaatcgatcatcaagaagatcaataaggcgcagaccgatgcggaaaccccaccgcgtatcgcttacgatgttgaaaacaaagcaggcatcgcgaacctgatgggactctattctgccgcgacaggtaaaaccttcgccgaaatcgaagctcagtacgcaggcgttgaaatgtacggcccatttaagaaagatgtgggtgaggctgtggtggccatgcttgaacccgtgcaagcagaataccaacgcatccgtaacgatcgcgaatacctgaacagtgtaatgcgtgatggcgcagaaaaagcctcggcaaaagcgctgcaaacgctgaaaaaagtctatgcggcggttggttttgtggcgcgtccttaagccaaagcgagcacaatcaagtcacagtgaataaagctagggtttcctagctttattttttgcacgcgagataggtttgcacagagcgaaagtgtgtgaggaattctcccatctgcgtttcacacggctacacttaaaacaccgaaatttaaaagagtgttagccatgagattcatgttgctgttgatgctagttgggatggcgcatggagcgctagccaaccccttacgtgtctgcgttggggacgttaatgtctggccaccgtttacctattggcaaggcagctctgcacaagaaaaggcagaatcattgacgggatcagccacgaccttggtgctcgaagcactgaaaaaacaagagatcgaataccaactgcatttcatgccatgggctcgggttcaacaagaattggcgcaagcgacaggtcgctgtgacctaacttgggatgctagctatcgagccgaaagggcggaatacagctatttctcggtaccgctctatacgatccagttgggctatttcaccttgccggaaaacagtaaggatttgaatctggctaccgacagcgatgtactgtgtggggtcaatggttttaactaccaaaatttcgcattaccacgagagccttcactgacactcaattctgtccagcaagccttaaatatgctgcaaaaagagcgttgtgattggttcgtgagtgaaattgagccaatttatggcgggatcatgttagggctctatcagttagatagaccgattcagcatcactttttaggcaaaaccaaggagtaccatgtgcaggtgcggcgtagcctaccgaacgcgatgccactcttaaacggccttaatgagtacattttacaagcccaatccagcggacatgcgcaagcggtttttgatcgcttcttgtcgataacgcaaaccgaataaatcgacgccgtggccgttatggcttctttctcctcccagagcggctcattcgccgctctgactatttaccccgcatgttgaaactttgcgatgcattcaagtatttactctattgatgagatgaacatctcgatatcaatgctgaatgtttttgtgttgcatgaaaaacagtaacactcatcgcgtaaagtcgtttttctttaacacaatactggttcaatacaccctgttttgtctgttaaccgcaaatagggaggagaaggtacatcatggaaatgagaacaaccccgaatttaacgcgctcaacgttagctttagcgattagttttggcttagtggcgccaagctacgctgacctattgatttctcaatacgttgaaggcagtagcttcaataaagcgattgaaattgccaacacgtccgatcaaacggtgagcctgaatggctaccaactggcgatgtcgaccaacggcagcggcacttgggataaaactttaccgctcgatggccaagtgattgcggcgcgcgatgtgctggtgattgcccacggtagcgccaatagtgcgatactggcgaccgccgacctaaccaacaacacagtggttaactttaatggcaatgatccgattgcgctgcttaatagcgatggttcggtgcatgacgtggtcggcagtatgggcggcgcagattttgcgaaagacaacacgctcgccagaacaacactcaccccaagcgctacttaccaagcttccgattgggcgacccaaggcaaagacaatattgatgggcttggcgcactggataccaccacgccaccgagtgccttcaattgtacgctagatggtgctgaaccaagctttaccaccatccaacaaattcaaggtgaaggcagtacttctccctatatccaaggctatccctacatcaccaatgaggatttctttgtcaaaggtgtggtgagtgcagtaacgacaggactgactaaaggcttctatctgcaatcgctggaagatgactacaacccgaatacctctgaagggctgttcgtgtttaccaaccaaagcagttcggacttagcaccgggcgatgtggtgtgcgtgaaaggcaaagtgcaggagtattacaacctgacgcagctcaaagcggaaaacaatcagtgggtgaaacaaggccagcaagctgcgccacaagcgcaagccatcgagatcttaccttccgatgaacactttgctcagacgctagagcgttacgaaggcatgctagtgaaaaccacacctgagctggatatgcgtgtgactcgcacctttggttatgactatgcttcgcgccgtaataacatggtgctggcacaaggtcgcattaatatgcagccaaaccagcagcatccagcgggttcagagcaagcttcgcagcagaagctggataacgcacagcgccgcttgtttgtggaatcggatgccaaagcaccagatggccaaattccgtattacccgacatttggccgcaccgatgtcgatcaagatggttcaaccgaagactatatccgaattgatgatacggtttcaggcctcgaaggggttgtgagctacagctataacgaatatcgcctgattgtgaccaacaccatctcggcagaaaatttggtgcataatgcgccgcgtcaagccaagccagatctggatgaaggcgatctgcgcattgccacgttcaacgtacttaactacttcaactcgccgtttggtggtgatgctaaccaacatggggataaccgtggcgccaacaatctggctgaatttgaagtgcagcaagccaagattgtgaatgcgattgtccgtttggatgccgatatcgtgggtttgatggaaattgagaacaacggctttggtgaaggttcagcgattgcgcagttggtgaatcagatcaatagccaaatcgcggataagaaaaaacactaccgctttgtggcgattgactcgaatggcgatggcaaaaccgatgctgccgattcactgggtactgatgtgatcaccacaggtgttatctatcgcgataaagtggtgaagctggcgcaaaatcgtgtcatcccaatgccaagtcagcaagcaccagaggtggtagatgccaacggtaaagtgattgaagatggcaaaaactatcagcgtgatacgcttgccccaacctttaaagtcaaaggtggcaacgagaaaatcactgtcgcggtgaatcacttcaaatcgaaaggatcagcgtgttgggaagatgccgcgcccgttgagcaaggcggacaagcaggcaaagatctcgattaccaaggcgcatgtgaaaacttccgcgtcgccgccgcggtagcgttgggtgatgcgctggcgaaaatcgatgggcacaaagtgattctcggtgatatgaactcgtacggcatggaagatcctatgctggtgctgacggactacacaccagagaaatacggcaaaaccattcgcgccgcacgcaatacttacattgccggtttggagcagtttggagatgcaggcgcagagatcaaacacagctacggttatctcaacgcagttgcaatgaaacatccagacagttggagctactcatttaatgatgaagtcggcgcgttggatcatctgttagtcagtccaagcctgaaacataaagtcgtggatgcgaccgattggcacattaacggtgcagaatcgaccttgtttgactacaacgatgagttcaaaggcaacctgccgaaatacaaggatcaattccgcgcctcagatcatgacccagcggtactggagcttaacatctacggtggttcattaggtttaggcgcactgcttggtctattggggcttggtgtttggcgtcgccgtcgctagaaagtggcatttttgataaaccaaaggctagcgtgtgctagcctttttagtttcttacgttggtggtgtgaacttactgcgcgtcgtgcagtatgctgccccataggtcgtattcatcggcgtgttcaatcacaacgttaaccagctcacccggtttcaggttggtttcaccattgaggtaaaccaagccatcaatttccggtgcatcggcgtaagtacggccaatcgcgccttcttcatcgacttcatcaatcagcacttgcatggtgctgccgatgcgtttttgcagtttggcagcactgatctcttgctgcacgagcataaagcgctcgaaacgatcttgtttcacgtcttctgggatttgatcttcaatctcgttcgctgcagcgccttcaacgggcgaatacttaaagcagcccacgcgatcgagttgtgcttctttcagccaatcgagcaggatttggaaatcctcttcagtttcgcccgggaagcccacgataaaggtggagcggatcaccagttctgggcagatttcacgccattttttgatgcgctctaaagtgcgctccgcttgccccggacgcttcatcattttcagcacacgagggctggcgtgttggaatggaatatccaagtaaggcaacacttttccttctgccatcaatgggatgatttcatccacatgtgggtaagggtaaacgtagtgcagacgaacccaaatgcccattttgccaagctcttcactgagcgctttgatgttgtggcgcaccggtgagccgttggcaaaacctaggctgtgtttggtatccacaccgtaagcactggtgtcttggctgatgacgagcagctctttcacgccagcatttttcaggcgttccgcttcaccaataatttcacccactgggcggcttaccaaatcaccacgcattgaagggatgatgcagaaagtacagcggtggttacaaccttcagaaattttcaggtaagcgtaatgctttggcgtcagtttcaccccgtgatccggcactaagctggtaaacgggttgtgggctggctttggcgcgtattggtgtacgtgctccaatacgttttggtaagcgtgtgggcctgtaataccgagcacattggggtgtacttggcgaatttcatcttcacgcgcgccgaggcagcccgtcacaatcactttgccgttctctttcagcgcttcgccaatggtatccagagactcttgcaccgcactgtcgataaaaccacaggtgttgacgatcaccacatcggagtcgtggtagctgttgacgatctcatacccctcagtgcgtagttgggtcagaatgcgttctgaatccactaagttttttgggcaacctaaggaaacaaagccaattttattgcctgtggtttggctattttggctttgctcggcgatggtttttttcgccgtttccagtgtcgtggtttgatttggcgtaaaagtctgaactgtcattgctctgtgtgctacctgataattatcgaatcaccgtccttatcgcttctgtgcagagcgtggctaggggacgggtataaaagtcggcgaattataactgagcttaggaaattgaataggggagagaaaggaaaattgcgcaaaaaatgcgcgcaaacgtctgctcaagtcggttaactttgcttaatgcttgcctttagagtggagtgctgcacaataacgcgcactttatttccatcccaaggtcgtatgcatgctactgatgatcgataactacgattcgtttacttacaacctgtaccaatacttttgtgagttaggggcgcaggtcaaagtggtacgtaatgatgagatcgatctggatgggatccgcgcgctggcaccaacacatttggtgatttctccgggaccatgcacgcctaatgaagcggggatctcactcgcggcgattgaagcgtttgcaggccaactgcccatccttggtgtttgtttagggcatcaagcgattgcgcaagcgtttggtgggcaagtggtacgcgctcgtcaggtcatgcatggcaaaacctcacccattcgtcatacgggacaaggcttatttagcggattgaataacccgctaacggtgacgcgttaccattccttggttgtgaaaaatgacactctgcccgagtgctttgagttaaccgcatggactgagcttagtgatggcagcattgacgaaatcatgggttttcaacataaaaccctagcccttgaagcggtgcagtttcaccctgagtcgataaagacagaacaaggccaccaattgttggcgaattttttaaaccgcacctaatcccaaaaacgatgcgtaaccagtgccgatcgtactgactgcgatcactttttttgctttctatcaaagatttatccgcaagctatcatttttcaagcttattcatagaggattgtgctacccgcgacatgccttgattttgctgcctctttgcttcatttcctatcgcctcataaaaatcacttcataaataatcttttttattgcataaatagtcgttcgtggtgtggggtttatctcacttgcctgtgcatacgagatctttcaccattgaaatagttaaataaatgtaaatacaatgctgcaaatgctttaaggaaatacataatctaacacagagccattttgtggaagaatcgcttatctctgagcatgcggtatcgagagggaatgggtaatgacggtggaaatgagtgtagatcggagttcttttgatgaggtgatggtgccttgttacaacccgatggagtttatcccagtaaaaggttttggttcacggatttgggatcagcagggtcatgagtacattgacttcgctggcgggattgcggtgagttgtctagggcattgccacccagtgatggtgcaagccttgaccacccaagccaataagctgtggcatttaagtaacgtaatgaccaatgagccagcgttgcgcttggcgaaaaaactgactcaagtgagttttgccgaaaaggtcttttttgccaactccggcgcggaagccaacgaagccgcactcaaactggcgcgtcgttatgcggccgatgtgtatggtcctgagaaatccgagattattgcctttaaccaaggtttccacggtcgtactttctttaccgtatcggtcggtggtcaagcgacctattcggatggttttggccctaaaccgggtgatattgttcatttgccttataacgatttggctgcactgcaagcgcagatctccgatcgcacttgtgctgtgatgatggagccgctgcaaggtgaaggtggcattgtttctccgagtgctgaatttgtgcaagcggtgcgcgagttgtgtgacaaacacaatgcactactgattttcgatgaagtgcagacgggtaacggccgtaccggtgatttctatgcctaccaagggattggtgtgacgccagatattctggcgaccgcaaaatctctcggtggcggtttcccaatcggtgccatgctgaccacggcgaaaattgctgagcacatgaaagtgggcgtacacggttcgacttatggcggtaacccattagcgtgtgccgtagcggaagcggtagtggatttcgtcgcgcaaccagaaatactggctggtgtgaaacagcgtgagcagtggatgcgcgctgagctagagaaaatcaatcagaaatatcaattgtttaaagagatccgcggtaaaggtttgctacttggtgcggcactcaacgatgaatggcaaggccgtgcgcgtgacattctggtcgctgcgggtaagcaaggcttgatggtgttggtggccggggcgagcgtggttcgctttacgccatctctcatcatcagccaacaagaaatcgaagaaggtatggctcgcttagacaaagcgatcgccacactgatgtgatagcgaagggtttgcatcgcaagccctgattgacgaacctcggaggttcgacgctatcgcaaactgcaggatgacgtgaggggcgaaaggttctcgccccgtgtccaatgcagagattacgcatcgggagggagtaaagatgctagttgttcgtccgattagcatggccgactatgaggcgctacatacctgcgctgtcgagtccggccatggcttcacatcattaccagtagatcaagagctactgactaatcgtattacccactcagaatacagcttcagcaaaccgaacgtcacaatgcctggtgatgaaggctatttgatggtgggtgtggatactgaaactgggcaagtggccggaaccacgggcattgaagcctcgattggctgggatgtgccgttttattcttatcacatcagcaccatagttcactcttcgcctaaattgggcgtcaataatgtagtgaagttgctgacgtttggtaacaactacaccggatgcagtgaaatctgcactctgtttttgcgcccacagtatcgccaaggcttaaatggtcgtttgatgtcgaaatgccgttttttgatgatggcggaacactcacaccgtttttccaaaaccatttttgctgagatgcgcggcgtttccgatgccgatggcaattcaccattttggaagtggctacaagagcactttttctcgattgatttcactttggccgattatctgactggaattggcaaaaaaggctttatcgctgacttgatgcccaaactgccaatttacgtcaacttgctgagcaaagaagcgcaagcggtgattggtcaggtgcatgaaaacacgcgacctgccttggtattgcttgagaaagagggtttcacctgtcgcaattacgtcgacatttttgatgcgggcccaaccgtggaatgtgagctgaacaatatcgaatcggtgcgccactcagtacgcgccattgttgaagtggcagaacattcgagctcgcagaatttcattatgtgtaacacctcgtttgagaacttccgggctacggcggccaaagccgcatacagccaagaagataacgcggtgatcatctcccccaaagtggccgcggcgttagaagtgagcacgggggattatttacggattttggcgcagtaggggatagccatgacacattggatagccggtgaatgggttgcgggaaccggtgaaaagctggaatcacatacgccttatagccatgagcttttatggcaaggttacagcgctagtggcgagcaagtcgacgcggcggtgaaggccgctcgccgcgcttttctcgactggaaaaaacgcccatttgctgagcgtgaacagaaggtgttggcctttgcggaattggtgaaagccaacagcgaacagattgcgcaagtgattgctaaagagacgggcaagcctttgtgggaaacgcgcacggaagcggcgtcgatcgccggaaaaatcgcaatttcgattcgtgcttatcatgagcgtaccggtgaaaccgtgcgtgaagcggcgggtaatcagctggtattgcgccatcggccgctgggcgtgatggcggtgtttgggccgtataacttccccggccacttgcccaatgggcatattgtgccagctctgctcgctggcaataccgtggttttcaaaccttccgaacaaacgccgtggactggcgaagttttgatgcagttatggcaacaggctggcttgcctgctggtgtcatcaatctggttcaaggctcaaaagagacggggattgcgctcgcgcaatcccgcgggattgatggtttgctgtttacggggagtgccaatactgggcatctgctgcatcgccaatttgcaggtcagccggacaaaatgctggcgctggaaatgggcggcaataaccctatggtgatttcagagcactatggcgatctggatgccacggtttacaccattattcaatcggcgtttatcagcagtggtcaacgctgcacctgtgtgcgtcgcttgtatgtgccacaagggacgaaaggcgatgcactgctcgataaactggtttccgtaacggccaagctgcgtattgatcagccctttgctgaacccgcaccctttatggggccgttagtttctgaagcggcagcacaagcgatcctcaaggcgcaagcagatctacaagcgctaggtggaaaaagtctacttgaagctcgcgccttgcatgcggcgtttatcactccggccatcatagatgtgacggcgattgagcgcttaccggatgatgagtatttcgggcctttgctgcaagtggtgcgttaccagactttggcgcaagcggtagagcttgccaatgatacccgctttggcttatccgctgggcttgtctcgacggatgatggcgagtgggattattttgtcgaacatattcgtgcgggtatcgtcaatcgtaaccgccaattaaccggagccagtggagatgcgccatttggtggcccaggagcatcgggcaacttacgccccagtgccttctatgccgccgactattgcgcttatccgatggcctcaatggaaggggatacaacgctgcttcctgctaccttgagcccgggtgttgaactctaatcataatttattttgtgcctgcgcagccaagtaggcacttttttcgtcacaggttgaaagctttatcgtgttagcgctgggtaaattacacagcgtttaaccttaatccctttgcgtttcttaggatcaacaaggaggcgttatgacgccaacagctttattccaatcgctctggaatgattatattgagcgcctctgcccatcggcagacagagtgcatcaactcctacaagaagatgagccgctgattaatgaccatattgcgctgcgcacatttaatttggcgccactggggttagagacgctggctaaaccgtttctggcactcggctaccaagcgtgtggtgagtatgagttcaaaagtaaaaaactctttgctaagcattttgaacatcccgatcctttgcagcctaaggttttcattagtgagctgaaagtggaagagtgttcacctgagctgcaagcgattgttgaaaagctggtggcacaagttcagccacaagcattagccagtgaggcttttttgtatggcggtcgcttatggagcttaagccatgccgactatcttactttggcgaaagagagtgagtatgccgcttggcttgcggcgcatggttatggtgcaaaccactttacagtcagcgtgaatcagctcaatgcgctgcatgaagtgaaacaggtcaatgaccatctgcgccaacatggctttagcatcaatgaatcgggtggggaagtaaaaggctcaccagaagtcttgctcgaacagtcttcgaccatggctgataaagtgttagtgcgttttaacgaaggcgcggagatgatccccggtggcttttatgagtttgccaaacgctaccctatggccaatggtcagctctatcccggatttgtcgaagcttcggcggataagatctttgaaagcacgaaccgttaaatctagcgcatcatacaaataaaaatagccaccgcagggtggctattttttataacacgagacgggttatcggggcacttagcgagtgccgtaaaccacgatggttttaccgtgggcagagatcaggttctgctcttccagcatcttcaggatgcggccaacggtttcgcgagaacagccaacaatttgaccgatctcttggcgagtgatcttgatttgcataccgtcagggtgagtcatcgcatctggctgacgtgcaagattcagcagagtctgtgcgatacggccagttacgtctaggaacgcaaggtcgccaactttctggctggtcacttgcagacgacgagccatttgacctgaaaggcgcatcaagatatctgggtttacttggatcaattgacggaatttcttaaatgagatttcagccacttcacaaggtgttttagcacgaacccaagctgtacgctcttggccttcttcaaacaagccaagctcaccgataaaatcaccttggttcaggtaagagagaatcatctctttaccttcttcatctttgatcagtaccgcaactgaaccttttacgatgtagtacagcgtttccgctttctcacccgcgtggatcagtgtgctttttgatgggtacttatgaatgtgacaatgtgaaagaaaccactctagtgttggatcggtttgaggtttacctagaaccataataatctcacttcctctgcagggtacgcttgccgctatccatattttagcgaagcctcaattgggcttactagaataagaggtgttacccaaggctgcaagctatcttatgtttcggttaagaatagtatcctttttcgaaatcgatttcttgattttaatcgtgtcagtagtccaatttgctacgcaaaaatgtgcacatgatcacggtatgaaaagtaagcattcatcactggtcggatctagccgatttttccggtttcgatcagttgttgcagtagcggacgcacaatcaaatccatcgcaaaactcatcttgcccccaggcaccacgatggtgttgtggcgtgacatgaatgagccatcaatcatcgccagtaagtaggggaaatcgacatttttgatgccacgaaaacggatcaccacaaaactctcatccagcgttggaatgcctttggcattgagtgggttagaagtatcgaccgtaggaacacgctgaaagttaatgtgggtgcgtgaaaattgcggggtgatgaatttgaggtagtcgtccattgaacggacgatggaatccatcaccgcttcacgtgaatggccgcgatcgcgtgtatcacgtacgtatttctgaatccactcaaggttaacaatcggcaccataccaatcaaaaagtcgacgtgttgtgcaacattgacatcaccatcgaccacaccgccgtgtaagccttcataaaacagcacatctgagttttcgggcagtgattgccaaggcgtaaacgtaccgggcatttggttatacggaactgcttcatcaaaggtgtgtaagtagcggcgcacttggccggtgcctacttttccgtattggcggaagaattcttcaagggttgggaaatcgttggcttggggaccaaagtaactgatatggcgaccttgctcgcgcgccttgcggatttctacatccatttctggacgagtgaagcgatgaaaactgtccccctcaacccaagcaggcttgatgctcatcatattgaacatcttgcgaaaggcttcagaggtggttgtagtaccggcgccggaagaacccgtcaccgcaataatcggatgtttggctgacatgacaaaccttgtcctttaagtccttgattttggtgctaacttagacaccttccgaaaaatgactatagcacggaaaatgctgtcgtcacggcatggctaaaacggatggcatttaatatccacggtttcatgcaattctgaatagacgatcacagcttgtccagattgtaattgagtacgtacctgagcaattttctcgtctagcgagacttcaatatcgccatagtcggtgccttcacgcagcacaaattctcggatcaaattgtcgagtgtctctggcgcaatctcttgccatggaatgatcataaatacctctttattttatgatggcgctgttttatgacggttcttttgtacgactgaaagaaacgacgagttgccccacgctcagtcgtttgaatgtcgctttcatctgtggagaatgaatcgtggattagctgggctgtagaaaatcatctcgcagcggtgcgtaatactcgggtagagcttgctctaaccaaaaatacggctttagccatgatccactcagaaagcccacatggccgccatgctcaaacaaacggtaatcgatgtttgctggtagcgagaaatcagggatcaccgcttcggtcataaacggatcgtctttggcgtggatgatctgagtcgggacgcggatctgagtcagctgtttaatcccggagcactgctgataataatcggcagcatcatgaaaaccgtgcagcggcgcggtgatcacatcatcaaactcggcgagtttagcgatagcgcggatccgctcagggctcagtggcaaagcgttttccagcagtgggtatttcgcgatggcatttttcttcaatgaagagagcagataggcgcgatacactttggaaaagccctgttcgatacgttgtgagcaggcggctaaatcgagtggcgcagaaatcaaggtggcggccgtgacgataggatcatcccgatactgcgcaagatagttggcgagcatgttaccgccgagtgaaacaccgacggcaacgatcggacgctctggtaattgtttacgcagatactccagcacaaaacgcgcatcgcccgtttcgccagagtggtaagcgcgtgctaagtggttgggtttaccactgcaaccgcgaaaatgcatcatcaccgagagccagccttgccgcgcaaaggcgtgcatcaagccgttcgcgtaagggcttttgaagctgccttctaagccgtggaacaacacaaacagcggcttacgctgcgcgtgtggtgtgcgccaatcttcgctccaagccagatcgagaaaatcaccatcaggcgtgaatagcgtttgccattcggcactaaacagcggctgttttcgcagcaagcgaggcagcagagtttgtaagtggggatttttcaaccccttagcagcaataaacgtgatcatgatgttggagtatcggattctcggtacggagctgaaaaaagctcggctaagtattctgcgccaagcattttacagtattgcagagtgagcgatagatcttgcgcaggatgaagtgtcattcgattgagacaatggaccaaatccgcttgctgttgcttttctaattgcagctcaaactgcagagcttcgcgatagagcgtgtctggcaaatggcttttcaagcgtcgccgcaaatcacgaaaatcgtgcagcagagtttccgaatgactcaaacattccagcaccgtcggccagtcagtttccgcaaaagtgagctgctgttcatctagccatttgagtaacagcagcagattgacattgccgtgatggctattttgcaatcgtaagcacgcctcttttacctcgcgcacactgtaatactgcaaactgaattgccagagtctttccagtgttaatcttggtttggcgtgctcatcactcatttatccgttgaacttccgttccatctcttctaaggtttcttgctcggccatccattctagctcgacttgctcaagctcggatttggcggcggcttgtttagccaacacctcagtcagtgtcgctttattctgtgcttcgtacagtgaggtgtccgacaattgtgcttccatctcactgacaacgtggttcaacttatcgagtttctcttctaactgtgtcaactttttgcgaattggcgcagtgagcttacgaaaatcggcttcacggcgcttttgctcttttttcgccgcggcactgttcgcgctattcgcagtattggtcggttgggtttctttacgctcggctttttgctgatcggtaagccatttgtagtagtcattcaagtcaccatcaaacgggccgacttggtgatcatgcactaaatagagatcatcggtggtagcacgcagcaagtagcgatcatggctgacaatgaccattgcgccttcatagctttgtagcgcaagggttagcgcctgacgcatatccaaatccaaatggttggtgggttcgtcaagcagcagtaagttgggcttttgccacacaatcaacgccagcactaaacgggccttttcaccacccgagaaaggcgcgactttttcgagcgctttctcaccatggaaaccaaagctgcctaagtagttacgcagctctagctcatttttgtctggcgcgatttgcatcatgtgttgcagcggcgtctcttctggatgcagtgtttccaactgatgctgcgcaaagtaaccaattttcaccccttgcgagtatgtgcagtcacccgattgcggtttgagctcacccgagagcagtttgatcaaggtggatttacctgcgccgttacgaccaagcagaccgatgcgactgcccggcaccagattgaggcggatcttctcgaggatgaggtgatcgccgtagcccgctgcgacctgatccatcatcaggatcgggttcggcagcgcggcaggttcacgaaactcaaagctgaacgggttatcaaactgggcgggcagcactttttccatccgctccagcgctttaatccggctttgggcttggcgagctttcgacgctttatagcggaagcgatcaatatagctttgcatgtgcgccatctgcttttgttgcttttgatagatggcttgttgctgaagcattttctgcgcgcgctgagtttcaaacgacgagtagttgcccgtgtattcattcagcgtctgattttcaatatgcacaatgcgattgacgattgggtcgaggaaatcgcggtcatgggaaatcaggatcagcgtgccggggtagctttgcagccaacgctctagccacatcaccgcatccaaatccaagtggttggtcggttcgtcgagcagcagtaaatctgagcggcaaatcagcgcttgcgcgaggtttaaacgcatccgccagccaccagaaaattgggtcaggctccagctcatctgctcttgagtaaagcctaagccgtcaagcagttctgaggcgcgagcgcgaatgctgtaaccaccgaccatctcgattttgccatgcaaatcggccactttggtgccgttgtcggccgcttctgcgtccattaattggcgctcaagttcgcgatattcgcgatcgccatcgataacgtattccaatgctgtgcgatccagcgccggggtttcctgtgctacccaagccagctcccagtgcgctggtttgctgaaggagcccgcatcaatggtgagttcatctttcagcagtgcaaagagagtggatttgccgcagccgtttttgcccactaagccgactttatcgccgggatgaatggtggctgaagcttgctcaaggagtggtttgccgccacgcagtagctgaatctcagaaaaggtaatcataaaaaaatagtttatcgcccgttgaattttcgctcggaatagtaggtggaataaggataaatgtcgatcattatacaaattgggttatgatgctgagtaacggattagtaacaaatcagcggagtgcgcaacttggtcaaccgagagcaaacgaaagccaaagtgctggtggtgtatgcgcaccccgatccacaacattccgttgccaatcaggtgatgatggaaaagattgccgatttagagcatgtttcgattatcgacctctacgccacttaccccaatttctttattgatgtgcatgctgagcagcagcgcttgcgggaacatgatgtgctggtgttgcaacatcccctctatatgtattcctgccctgctcttttaaaagagtggatcgatcgcgtgttgagcaaaggtttcgccttcggtaaacagagtgagctgaaagggaaactttggcgcagtgtcatcaccactggcggcaaccacaccgcctacgatcaacgtggttataaccgttatccgctgaatgaaatcctgcagccgttcgagctcagtgcggctttgtgtcagatgcactggattgagcctttggtgctgtattggtcacgcaacatcagtgatcaagagcgtgcgcaacatgcagagcgttatcggcaatggctacaagagatcgcccactggcaaggagagccgtatgacgccactgaccagtgattttctcagtagcagtgtcgtctttctgagcgctgcggtgattgccgtaccccttgcgcagcgcgcgggattaggctctgtgcttggctatttgctggcggggattgcgattggtccatggggactgggcttgatccgcgatgtgcaagccatcatgcattttgctgagtttggcgtggtgctactgctgtttctgattggcttagagctcaacccgaaaaaactgtggaatctacgcggccccattttagggctaggcggcgcgcaagtggtggtgaccactgcggtgctttccagtgtcgcgtatttactgggtgtcagttggcaaagtgcgttagtcatcggtatggcactggcgctttcatcgaccgcgatcgctctgcgcgtgattgaagagcacggcttaacgcgtactgaggcggggcaatcgggatttgcggtgctgctgtttcaagatattgcggtgatccccatgttggcactgctgccaatcctcgctggaaacagcagtggcgattggctgaatgccctgtggatgacgggaggaattgctgctttgttactgggcggacattttctgcttaacccgctgtttcgatacattgcattaagtggcgtgcgcgaactgtttactgtcgcggctttgctcttggtggttggcatcgcgttgctgatgcagaaggttggtctttcgatggcgctaggtacttttttagctggggtgatcctcgcagaaagcgagtttcgtcatgagctagaaatcgctatcgatccttttaaaggcttattgcttggtctgttttttatttcggtgggtatggcagtggacgtgggtttgttactcgtcaagcctctgcagattatgctggccgtgttgggcttagtgattgtcaaaggtctagtgctctatctgctggcacgcctgtcgggtacggttgccaaagcgcgcagcaaaatggcagcgattttaagccaagggggggaattcgccttcgtgatttttaccgccgccagtgcggagggcttgctgacggcctcgcaagtctccttccttctggtggtggtgagcctttctatggtgaccacgccgttattactctctgcccaaaaatactggtttgcccgccagctcaatattgaagagaacccactgacgccggatgtcgaaaataaagagccgcgagtgatcattgtcggttttggccgctttggtcagatagtggggcgtctgctgtacgccaacaaaatcaaagtcactattttggaaagtgacgccagccaagtgcgtttactgcgtaaatacggctacaaagtcttttatggggatgccaccaatctggaactattacgcgccgcaggtgttgagcaagcagaggctttggtggtttgtaccgatgaccctgagcaagtgatcaccatagtggagttgtgtcagcagcattttccgaatctgaaattgttggcgcgagcacgcagtcgggtcgaagcttatcaactgatgagtctcggagtacaaaattacacccgagaaaccttcttgagcgcactcgacttggggcgcaaagccttggttcaacttggcatgcatccttatcaagcgaaacgtgccgaagagcattttcatcgtctcgataaaaccatgctcaaagaattgctaccgcaacataatgaagataaacaactcgaactgcgcgccaaagaagcgcgtaccgaacttgaagaaatatttagccgtgagatggacagtgaccagctctcacgccgatattgggaaaaggagtagtacaatctcgtgaaacagaaaaaacgttttatcgctggcgcaaactgcccacagtgcaagaccgccgatacgttacaatggtgggtagagaacagcattgagctggttgagtgcgtcgaatgtgggttccatgaacagcgtaaacccaaatccgtcgagcagagtgagcatgcgaatgagcagatgatcgggatttttaagccggagtaattgagtttctgcgtgtgatcttcataatatcggcaacattcttctcttggcctgcatttggcagtcaagagacaacctccctggagcagttatgaaaattgaaaaaaacacggtagcaagtcttgcttaccaattgactatcgaagatggcgtggtggtggatcagtctactgttgatgcgccgctggattacctgcacggtcacaataacctgattacaggtcttgagcgtgaattggaaggcaaagtggctggtgataaattcaccgttactatcgcaccagaagatgcatacggcgaacacaacgaagatctggtacagcgtgttcctgcagacgtgttccaaggagtggatgagctggaagtaggcatgcgtttcctcgccgatacagaccaaggtccaatcccagttgaaatcactgaagtggatggcgatgaagtcgtagttgatggtaaccacatgctggctggccagtcactgactttcaccgtagaagtggttgccgtgcgcgcagcgacggaagatgagattgctcacggccatatccaccaagcgggtggctgtggtcatgaccacgatcacgaccatgatcatgaaggcggttgctgcggtggcgaaggccacggtcacgatcaccatggtcacggtaagaaagaaggcggctgctgtggcggcggcggttgtggttctcactaatagtgagcccatctcgctaggtagtacgttattttcgtagtacgactgatttgaaagcgctaaccgcgatccggttagcgcttttttattgcgaactttggcactatacgcccattctaaacgccgaaataaaacggttaaccttattggagaacacaagtcatgacacagccttttgcgattgccatccatggcggtgccggcacgattttgcgtgagcagatgagtgatgcattgcgcatggacatcctcgcgacattagagcaagccgtgcgagccgggcatcagctactggttgaaggagccgatgccttagatgcggtggtggcagcggtgacagtattggaagactcgccactgtttaatgccggcaaaggctcagtactgacgcacaatgaaatggtggagatggatgcctcggtgatgcatggcgcagcccgagaggctggcgcgattgctggtgtgcgccatattcgcaacccgattcaactcgcgcgcgatgtgctgcgtcatagtgatcatgtgtttttgattggtgatggggcggagcaatttgctttccagcaagggcatgtttataccgagcaagattattttttcactgagcgccgttatgaacagctgcaaaacatgaagcagcaagatcgcttcgcactttcagaagcttcctatcaatccgagtctgctgaacaagagtcgccaagtgaatatcccgatgataagaaatttggcacggtaggcgcggtggcgttggatcaacagggcaatttggcggcggcgaccagtacgggtgggatcaccaataaacgctttggtcgcgtgggcgactcgccaatcatcggcgctggaacgttagctgaaaatggcaatgtcgccatttcatgcaccggaatgggcgagtacttcatccgttatgcggttgcaggcgatattgcggcacgcatgcgttatctcaaagaagatgtccataccgcctgtgaaaccgtggtgcaaggtgaactgaaaagcgtaggtggtgaagggggattaattgcgattgatgcgcagggtgaacttcactttgccatgaacagttctggcatgtatcgcgcggggattgatcgcgatggtcaattcagtgtgaaaatttacgctgacgaataaccttttcttaataactgaatggattttcaaagccgttttatatgaatttttcatgcttaaaaaatgactgcaaggattcaaattcggtgctagaatccttttttaactagcaatcagacttggaaagatgggtaataacgttgtcgttcttggcacccaatggggtgacgaaggtaaaggtaaaatcgtagaccttttaactgaagatgcaaaatacgtggttcgctaccaaggcggacacaacgcaggtcacacactagtaatcgacggtcaaaaaaccgttctccacttaattccatccggtattcttcgcaataacgtgaaatgcatcatcggtaacggtgtagtactttcaccagaagcattgatcaaagaaatgtctggtctcgaagatcgtggtgttcctgttcgcgagcgtcttttcatttctgaagcttgtcctctgatcctgccataccacgttgctcttgaccaagcgcgcgaagccgctcgtggcaagaaagcaatcggtactactggtcgtggtattggtcctgcatacgaagataaagtagctcgtcgtggtctgcgtgttggcgacctattcgatatggcttcttttgctgagaaactgcaagaagtgatggcattccataacttccaacttgagcacttctacaaagtagaaccagtaagctacgaagcggtactggagcaggcgaagggttatgcagaactgctgacttctatggttatcgacgtaaccaacgaactggatgcagcgcgtaagcgtggcgataaaatcatgttcgaaggcgcgcaaggtacactactggatatcgaccacggtacttacccatacgtaacgtcttcaaacaccactgctggtggtgttgctgcgggctctggttttggtcctcgtcacctaggttacatccttggtatcgcgaaagcgtactgcactcgtgttggtgccggtccgttcccaacagaattgtttgacgaagtgggcgatcacttaggcactaaaggccatgagtttggtgcaaccacaggtcgtaagcgtcgttgtggttggtttgatgcagtggcaatgcgtcgcgcgatccaaatcaactcagtaaccggcttctgcctgaccaaactggacgttctagatggtctgaaagagatcaagatctgtacgggttaccaaatgcctgacggttctattgctgaagtttcacctatggctgctgacgcatttgaaaacgtgacgccaattttcgaaactatgcctggttggtctgaaacgactttcggtgcaaaaacgctggctgaactgccacagacagcactggattacatcaagcgcatagaagagctgactggcgttccggtagacatcatttctactggcccagaccgcaacgaaaccatcatcaaagttcacccattcagcgcgtgatcttgagataaaaaacagtaagccgactcaccgagtcggcttttttttgccatactcttggtggtattttgtgcgcctgtggcaaaaagttgccgcaaaacggtaaacggggctaaagcgattgcattcaatgccgatatagaaagcaatccgggtcaacgtgcaatgcggcgcgtggtgactgccggtgtttataagagtgcgggtatgaagctacgaacggtagccgcttccttattgcttgcatggcactcctcttacaatcctgcttatgcagcggatttaggagagccagtgcctatctattcggaagctgagctaatcaaactgattgaagaaaataagcatcttgagcgcgtaaaagcggataattgccagatcgtggaagatattgtcgcacgtgcgacacgtatcagtctgccctcttatgagtttctgtatggcgatatgctggcttggggagtgtgtgtggatcaggatgttgagctgggtctctactatatggagaatgcggcgcatcaaggtttgcctgctgctctggagcagcttgggcgctactactcacgcggcaccttagttcaacaagacaaagaacgcgcgatcccctatctgcgtgaagcagcggcaatgggcaatcttaatgcgcgtattcagctcgctgaactgttactgcgtgattacggcagtccgctcgattatgaagatgcctaccgctggttgtataactcggtcactgccgatcagcgtactcacaatcgtatcgctctgctgcgtcaaggtttagagcgtaggatgccggaaaatatcatcgcgcgagccaaacgccgagaaacgttctggtaaagccgctttaccagaactggttccctttagcgcaagaattgccgcatctcttcaagcgcctgcatgatctgctgagtcgaaatttgacgctctttctctggggcaagttctgaattgagagtctcgactcgcccggtggggtagctcaccaacatctctttatcactcactaacgcatagttaaagtaactaccgataatcgtccattcccgttgtgggctctcttgccaaagcgggtagcctaacgcaaattcattgagtggattttgtacccctaacacttcttgcatcaacataggcgcaatatcgaggtgggtggttttgtgcgttaatacgcttccttctttgtcaggaatgtagatgtaaagtggtacatggatctgcgccatgctgtagttactgccatgtccccaataattttgtcgattgtcattaaactcttcaccatgatcggatgtgatgatcactatggtattgcgcagctcatcacgggcttgcaactgctcaagaactttgccaatcaaactatcagcgtaatagagggcattgcgatagcggttatggtacggctcgggatcaaaatcgttgttgagtttgatgtgatcgactcgctcccaataaggggtgaaaggtggtgtcatcgagcttgggaaatcagccgcatgcgctgaatcgtaaaacagaaaaccgaagtagggcttgctacgatcccgttgctctaaaaagtgcaaaaaatcctcagtaatacgttcatcacgctgtggtgagttttctccaggcgtgactgtacgtagctgggcaattttgctgaatatcgttcggtcaaacggtgggctattgagtggtgccgagccgtaaatagcaaactgatagttcaaatctgcgagagtttgcatcagcagtgggcgagtttggctggtttgaaactcctcccaataggtagcgggtaagccgtaaaagagactgaataagccagcttgggttgaatttccaccacttaagtgatgagtaaagcgcgtggcttgttgaccaaagtgagcaatgttgggcgtcacatcgcgattggcatcatcaaaacgccaagcatcaatcccaatcaataaaatgtttgggcgctctgcaggcggttcaatgtgcagaggtcgcagcggatagttgagagtactgctggttggtgcatgaaaatccacctgctgacggcgggcggattgcgcatcaacaacaccgagctggtcgaaaaagcgttttgcggtcaacggataatagagcggccagtgatagctgtagcttgggatctcactgtcataagtggcatctttccaagcgtggataaactggctactcagcaatgaaagtaaccaaaccgccgatacccagcgaactccacgtgaatgttgaatgcgttgcgccagtttcatgatgagccattgggcaaagccgaccacgaagacaataaagcctgccatcgcaagggtataccacgacacgctgatcacttgctgtccaccatgcaacagcaaatcccacacaaagccactcagatggaatcggtactgttgatacacttcaatatcgaccatcaacaaaatgctcacggcccaagaggctacaaacacaacaccgtgcagtaggcgactcgggagccaaaccagagcgagtgaaaccagcgtgatggcaaaggcaaataacccaaaccagccaaactgggtggccgaaagataagcgtacgctaccctattactgctgctgacctccatccattgcaaataggggaggcccaatacagctaataaaacagcattcaaaataaagtgactaaaaagccactctatattcttttttatcatcaataacatgtggaatccccgtagcaaatgggattggttggacagcaaaattgctgcaaataataacttaaaagttgacctatgtcacattacctagaatgatgaaagagttctgtgcgttgtcattagttgttcgtagtgacaaagcagtaggatataactaacaccttcctagataagcaggtctgcctatgtctgataccacacatcttgatcctttcgctgatcgcgaagccgacaattatgacaatccaattccgagtcgtgagtacattctcgaatttttaacccaagccaatgttcccatgaatcgcaacgatctgttcgaagccctcaaactagaaggcgaagagcaatatgaagggttgcgtcgtcgcctgcgggcaatggaacgagatggccaactggtgttcacgcgccgtcaatgctatgccttgccagaaaaactggaaatggtgaaaggctatgtgattggccacaaagacggccacggctgggttcgtccagaaggaagcttaaacaaagaaggcgatattttattgccccaccaccagatgcgtacgctgatccatggtgattttgtcttagtgcagccgagcggtactgataaacgaggccgtaaagaagggcgcttagtacgcattctcgaagagcgcaatggccaaattgtcgggcgtttcttctttgaatacggttactcttatgtggtgccggatgactcacgcattcatcatgacattctgatccccaatgacttacgtgccggcgctcgcatgggcaacgtggtcgtgattgaaattaccgaccgtggcacgcgtaaccgcggcatgatgggtaaagtcgttgaagtgttgggtgaaaacatggccccgggtatggaaacgcaaattgcgattcgtactcaccaaattccccatgaatggcccgcagaagttgagcagcaagtagcgggattgaccgaggaagtacctgaagaagccaagcaaggccgtgtcgatctacgtgctttgccattagtcacgatcgatggcgaagatgctcgagatttcgatgatgctgtctattgtgaagcgaaaaaaggcggtggctggcgtttatgggtcgcgattgccgacgtgagctattacgtacgtcccgataccgctctcgataaagaagcgatcaaccgcggtaactcggtctatttcccatcgcaagttgtcccaatgttgccggaagtgctgtcgaacggcctctgttcactcaacccacaagtcgatcgcttgtgcatggtgtgtgaaatgaccgtatcggaaacgggtaagctctcgggctacaagcattacgaagcggtaatgaactcgcacgctcgcctgacttacaccaaagtgcatgaaatcctcgaaggggatgaagaactgcgcgagcgttataaagcgctggttcctcatcttgaagagttgcacaaaatgtatcaggtgctgaaaagtgcacgcgatgagcgtggcgcgattgagtttgaaaccgttgaaaccaaattcatcttcaacgctcagcgcaagattgaaagcattgagcctgttgtacgtaacgatgcgcataagctgattgaagagtgtatgatcctcgccaacatcgcctctgcctctttggtagaaaaagccaaagaagcggcgttgtaccgtgtccatgagccaccaggtgaagaacgtctcactggcttccgtgatttcctcggtgagttggggctcgatctctccggtggccttgagccatcaccgaccgactacgccaatttaatgaagcaaattggtgaacgtccagataaagagctgatccaaaccatgttgctgcgctcgatgaagcaagcggtgtataacgcggataacgcgggtcactttggcttggcgttgaaacgttacgcacactttacatcgccaatccgtcgttacccggatttgttgctgcatcgtgcgatcaaatatctgatcgcgaagcaagaagggcgcaaccaagaccgttggactccaaccggtggctatcactactccttcgatgacatggacttctacggtgagcagtgctccatgactgagcgccgcgctgatgatgcgacgcgcgaagtgtctgactggctcaaatgcgagtatatgcaagatcatgtgggtgaagaattagaaggcgtcgtcgcgaacgtcaccagtttcggcttctttgtccgtctcactgagctgcacattgacggcctggtacacatttcgactctggctaacgactactaccactacgatccgattggtcagcgtctggtgggggaaagttttggtgccatctatcgtcttggtgatgcggtaaaagtaaaagtgttggcggtaaaccttgatgatcgccaaattgactttgaattggtcgaaactagtcgtaagctacgcggccaaggtaaaaccgccaagaaacgtgccgatgaagctcgagccaaagcgcaaggtaaaaaagaagcggccactaaaggtgcctgtggcaaatcaccaacgaaatcagagttgaaaccacaggtagaagcgacgcgccgtccagacagtgaaggccgtagcaaaccgaaaaagaccaaagcgccgaaaaaacgcaaagaccaagctcgtaagaaaagcggcaaagtacgagataaaaccaaataggtaacacatgagtaatgaattgatttatggcatccacgccgtgaacgcggtactacaacgcgatcccgcgcgttttgtcgaagcgtatgtgcttaaaggtcgtcaggacgatcgcctgctgccggtactcaacgaattgatgcgtcttggcgtctcaattcaagagatgagccgcaaagcgctggatgacaaagcggaaggcgccaatcatcaaggattgattgcccgtgttaaacctgctcgtcaactcaatgaaaatgaccttgacgatatcctcgctcagcatgagcaacccctgttgttagtactggatggggtaactgatccgcacaacctcggggcttgcctgcgtaatgccgatgcggcaggtgtggcggcagtcattgttccgaaagacaaatcagcaccactgaccgcgaccgtcagtaaagtggcgtgtggcgcggcggaaacggtaccgctcgtgcgcgttactaacttggcgcgtaccatgcgcgcactgcaagaaaaaggtgtctggtttgtagggactgcaggcgaagcgactcatgatatctatcaaagcaaactgaccgggtcgctggcgattgtaatgggcgcagaaggggatggcatgcgtcgtttaacgcgtgaaacctgtgatgatttgattaaaatcccgatggcaggcagcgtatcaagtctaaacgtgtctgtagcttgtggtgtctgtttatttgaagcagtacgccagcgtatggcgaatcggtaagttcaatcattccatcatcgtaaacgggcacttgagagtgcccgtttttcttatcatccctaaaccacggcatttagcggtcgtgattgtttggcgcatgcataaacactccagtgacgttatcgttaacagagatttaattccgtttatttttcaaacataccttgcaactgaaactgtgatcggtataatgcccggcactggtttagccagttgtgaaccaatgagcagtgaggagctgtcccatcttattgataggtcaggtaatgtatactcagcttatgttcgcagttaataaaaatttagctttctactatcttgcgatagttcaggttaatcacctattagctgacaatgcgtcctaatcttggatgctacggtttcacataaatcaatcggcattctctcgtcttatcgagtttgagtggcgatattgtttgtgtaattttttaatattggagctctgtctcatgcagaaccaacgtatccgtatccgcctgaaagctttcgattacaaactgatcgatgcttctacagcggaaatcgttgaaacagctaagcgcactggcgcacaggttcgtggtccaatcccactgccaactcgtaaagagcgtttcactgttcttatctctccacacgttaacaaagatgctcgtgatcagtacgaaatccgtactcacaaacgtctaatcgacatcgttgaaccaacagacaaaactgttgatgctctgatgcgtctagaccttgctgcgggcgttgacgtacaaattagcctaggttaagggagattagaagaatgattggtctaatcggtcgtaaagtgggcatgacccgcgtatttactgaagacggcgtttctatcccagtaactgttgttgaagttgaagcaaaccgcgtttctcaagtgaaaactcttgaaactgatggctacgctgcaatccaagtcactactggttctaagaaagctaaccgtgttactaagccagaagctggtcacttcgcgaaagcgggtgtagaagctggtcgcggtctttgggaattccgtttggaaaacggtgaagagtttgcagtaggttctgaactgactgttgaactgttcaacgaagtaaaaaaagtagacgttactggtacatctaagggtaaaggtttccaaggtgctgttaagcgctggaacttccgcactcaagatatgactcacggtaactcattgtctcaccgtgctcctggttcaattggccaatgtcaaactccaggtcgcgtgttcaaaggcaaaaaaatggcaggtcacatgggtgctgagcgtgtaacgactcaaaacctagagatcgtacgtgttgacgctgagcgcaatctgcttctgattaaaggtgcagtcccaggcgcaactggcggtaacgtgatcgtcaaaccagctgttaaagcgtaacgtctaggagtaagtaatggaattgatggttaaaggtgctaacgcactaactgtttccgaaactactttcggacgtgagttcaacgaagctcttgtacaccaagtagttgttgcttatgcagcaggtgctcgtcaaggtactcgtgctcaaaagacacgttcagaagtttctggcggtggcgctaagccatggcgtcaaaaaggtactggccgtgcacgtgctggtacaatccgtagcccaatctggcgtacaggtggtgttacttttgctgcgaaaccacaagatcacagccaaaaagtaaacaagaaaatgtaccgtggtgctatgaagagcattctgtctgagctagttcgtcaagagcgtttgatcgttgttgaaaacttctcagttgaagctccaaagaccaaagctctggtagctaagctaaaagaacttgagctgaacgatgttctcatcgttactggcgaagtagacgaaaatctgttcttagctgcgcgtaacctgtacaaagttgacgtgcgtgacgtaactggtatcgacccagtaagcctgatcgcatttgacaaggttctaatgactgctgctgcagttaagcaagttgaggagatgctggcatgatccgtgaagagcgtctactaaaagttctacgtgctccgcacatctctgaaaaagcaactatgtctgctgagaaatcgaacactatcgttttcaaagtagcaaaagatgccactaagaaagagatcaaagcagctgtagaaaagctatttgaagttgaagttaagtctgtaaataccctgatcatcaagggtaagaccaagcgtcaaggtctgcgccaaggccgtcgttcagacgtgaaaaaagcgtacgtgactttgaatgaaggtcaagatcttgacttcgttggcggcgcggaataacaggagtagttgaaaaatggctattgttaaatgtaagccgacttcggctggtcgtcgtcacgttgttaaagttgttaacgctgacctgcacaagggtaagccatacgcacctcttctagagaaaaactctaagaacggtggtcgtaacaacaacggtcgtatcacagtacgtcacatcggtggtggccacaagcaacactaccgtttggttgacttcaaacgtactaaagacggtatcccagcgaaagttgagcgtctagaatacgatccaaaccgtagcgcaaacatcgctctagttctgtacgcagacggtgagcgtcgttacatcattgcaccgaaaggtctgcaagcgggtgacgttatccaatctggcccagatgcgccgatcaaagcgggtaacgcaatgccaatgcgcaacatcccagttggttcaacaatccacaacgttgaattgactccaggaaaaggcgctcagctggctcgttctgctggtgcttacgcgcaacttgttgctcgtgatggtgcatacgtgactctacgtctacgttctggcgaaatgcgtaaagtactgtctgaaggccgtgcaactatcggtgaagtaggcaacgctgagcacatgctgcgtgaactaggtaaagctggtgcagcacgctggcgcggtgttcgtccaaccgttcgcggtgtggtaatgaacccggttgaccacccacacggtggtggtgaaggccgtacttctggtggtcgtcacccagtatctccttggggcgttccaaccaaaggctacaagacacgtagtaacaaacgcactgacaagtacatcgtacgtcgtcgtaataagtaatctatttaagaggataagccatgccacgttctctcaagaaaggtccatttattgacctacacttgctgaagaaggtagagaaagcggtggaaagcggagacaaaaagcctattaagacttggtcccgtcgttcaatgatcattccaacaatgatcggtttgaccatcgctgtccataatggtcgtcaacacgttccagttttcgtaactgacgagatgatcggtcacaaattgggcgaatttgcacctactcgtacttaccgcggtcacgctgcggataagaaagctaagaagaaataaggggtaaataatggaagctatcgctaaacataactttgctcgtatttctcctcagaaagctcgcttagttgcagaccaaatccgcggtaaatctgtggatcaagcgctagaacttctgactttcagcaacaaaaaagcggctgaactggttaagaaagttctggaatctgcaatcgcgaacgcagagcacaacgaaggtgcagacatcgacgatctacgtgtcgctaaaatcttcgtagatgagggcccagtcatgaagcgtattatgcctcgtgctaaaggccgtgcggatcgtatcttgaagcgttcaagccacattactgtggttgtcgcagatcgctaagagactaggagagtaagcaatgggtcagaaagtacatccaaatggtattcgtctaggcatcgttaagccttggaatgctacatggtttgctaacaccaaagatttcgctgacaacctagacggcgacttcaaggtacgtcaatacctgtctaaggaattggcaaacgcgtctctgtcacgcatcgttatcgaacgtcctgcgaaaagcatccgtgtgactattcacactgctcgtccaggtgttgttatcggtaagaaaggcgaagacgttgaaaaactgcgtgcagcagtagcaaaaattgctggcgtaccagcgcaaatcaacatcgctgaagtacgtaagcctgagctggatggtcagcttgtggctgatagcatcgcgtctcaactagagcgtcgcgtaatgttccgtcgtgctatgaagcgcgcagtacaaaacgcaatgcgcctaggcgctaaaggtatcaaagtggaagtaagcggtcgtttaggcggcgctgaaatcgctcgttcagagtggtatcgtgaaggtcgcgtacctctacacactctgcgtgctgacattgattacgcaacttcttcggctcacaccacctacggtgtaatcggcgttaaagtctggatcttcaaaggtgagatcctaggcggtatgccagcagcaactgaagctgcagagccaaaggctgacaagccgaagaagcagcgtaaaggccgtaagtaaggagtcgacagatgctacaacctaaacgtactaagttccgtaaggttcagactggtcgtaaccgtggtctagcgaaaggtacagaagtaagcttcggtacttttggtcttaaagctgtaggccgtggtcgtctgactgctcgtcaaatcgaagcggcacgtcgtgctatgacgcgtcatatcaagcgtcaaggtaaaatctggatccgtgtgttcccagacaagccaatcactgaaaaaccactagaagttcgtcaaggtaagggtaaaggtaacgttgagtactgggtagcccaaatccaacctggtaaggttatgtacgaagttgatggtgtacctgaagaattggcacgtgaagcgttccgcctagcggctcgcaaactgccattcaagactacattcgtaactaagcaggtgatgtgatgaaagcacaagatctacgcgaaaaaagcgttgaagagctgaactctgagctactgaatttgctgaaagagcagttcaacttgcgcatgcaagctgcaactggtcaactgcagcagactcatactctgaaagctgtacgccgtgatatcgcacgtgtgaaaactgttttgactgagaaggcaggcgcataatgagcgacaaaattcgtactcaactaggtcgtgttgttagcgacaagatggacaagtctatcgttgttgctatcgagcgcatggtgaagcaccctatctacggtaaattcgttaagcgcacgactaaagtacacgcacatgacgaaaacaacgagtgtggcattggcgacactgttgaaattcgtgaatgtcgtccactgtctaagactaagtcttggactctggtgaaaattgtagaaaaagcgaagatgtaatctcctctctttctcgcaattcaggcggctccaattatttttggggccgcttgttttttgactacccaatcaaaaaaaagggtggtacaattcgcgtccctttaaagaggcagcccgacccgagatgggtctagtttttttaatatttagcggagcactaacatgatccaaatgcaaactatgctggatgcagctgataactcaggcgctcgcagcgtaatgtgtattaaggttctgggtggctctcaccgtcgttacgcccacgttggcgacatcatcaaagttaccgttaaggaagcaattcctcgcggtaaagtaaagaaaggtgatgtattaaaggcggtggtagttcgcacccgtaaaggcgtacgtcgtccagacggttctgtcattcgcttcgaccgtaatgcttgcgttctgttgaacaacaacagtgagcaacctatcggtacacgtatctttggtccagtgactcgtgaacttcgtaatgcgaaattcatgaagattgtatcactggctccagaagttctgtaaggagcggcaacaatggcagctaaaatccgtcaaaatgacgaagtaatcgttcttgctgggaaagacaaaggcaagaaaggtaaagtaactaaggttctggcaactggtaaagttatcgttgaaggtatcaatctagttaagaaacaccagaaacctgttcctgcgatgggtgtccaaggtggcatcgttgagcaagaagcagcgatcgacgtttctaacattgcgattttcaacgcaaaaactggtaaagcagaccgcatcggtttccgtttcgaagatggtaagaaagttcgtttctttaaatctaacaacgaaatcgtttctaactaattagaagtaatttggagttctactatggcgaaactgcatgattactacaagtcgtctgtagtcgctgagctgaccaaacagttcagttacacaagcgtcatgcaagtccctagaattgagaaaatcaccctcaatatgggcgttggtgaagcaatcaacgataagaaactacttgaaaatgcagcgtctgatatggcgatcatctctggccaaaagccactgatcactaaagcgcgcaaatctgtagctggtttcaaaattcgtgaaggctacccaattggttgtaaagtaaccttgcgtggcgagcgcatgtgggatttcttggagcgtttgatttctatcgctctaccacgtgtacgtgacttccgcggtgttaacggcaagtcttttgacggtcgcggtaactacagcatgggcgttcgcgagcaaatcatctttccggaaatcgactacgataaagtcgatcgtgtacgcggtcttgatatcactatcacgactaccgctggtaccgatgaggaaggccgtgctctgctggctgcctttaacttcccattccgtaagtaaggtgaagggttactgttatggctaaacaatcaatgaaagcacgtgaagaaaaacgtgcgaagctggtagctcagttcgctgaaaagcgtgcaactctgaaagctatcatcagcgatgtaaacgcatctgaagaagatcgttggaacgcggttcttaaactgcaatctcttccacgtgattcaagtcgttctcgtcagcgtaaccgttgcaaccaaactggtcgcccacacggtttcctacgtaagttcggtctaagccgtattaaagttcgtgaagcttgcatgaaaggcgagattccaggacttcgtaaggctagctggtaattgccacttaatcatttggagtaaagtttatgagcatgcaagatccgatttcggatatgctgacccgcattcgtaacggtcaggcagcaaacaaagttgctgtaaaaatgccttcttcaaagctgaaagttgcaattgctgcacttctgaaagcagaaggttatatcgctgatttcgctgttgaaggcgaagtgaaagcagagctggaaatcactcttaagtatttccaagcaaaaccagtaatcgagcaaatcaaacgcgtttctcgtccaggtcttcgtgtttacaagaagaaagacgagctgccatctgtaatgggtggtctaggcgttgctgtcgtttccacttccaagggtctgatgtcagaccgcgctgctcgtaaagcaggtcttggcggtgaaatcatttgctacgtagcataattaaggagtagaacatgtctcgtgttgctaaagcacctgtcgctattccagctggcgtagaggtgaaactgaacggccaagagatcactatcaaaggtgctaaaggcgaattaactcgcgttttccacaatggtgtagtgatcgcacaagaagacaaccaactgacttttggtccacgtgaaggcgtagccaatgcatgggcacaagcaggtactgcacgtgctcttgttaagaatatggttgttggtgttactgaaggctttactaagaaactcgttctgaagggtgttggttaccgtgctgctatgaaaggcaacgctgtaggcctgactctgggtttctctcaccctgttgagcacgagctgccagcgggtgttaaagcagaatgtccaagccaaactgaaattgtcctaactggttgcgacaagcaagtagttggtcaagttgcggctgacattcgttcttaccgcgcgcctgagccttacaaaggcaaaggtattcgttacgcagatgaaaatgtgcgtagtaaagaagctaagaagaagtaaggtaacactatggataagaaagcatctcgcatccgtcgtgctacacgtgcacgtcgtaagattgcagaactgggtgcaactcgcctagtagtacaccgtactcctcgtcatgtgtacgcacaagtgattgcagctaatggctctgaggttatcgccgccgcttctactgtagaaaaagcgatccgtgagcaagtgaaatacaccggtaacatcgatgcagcgaaagcagtgggtaaagctgttgcagagcgcgcacttgaaaaaggcgtaactgtagttgcgtttgatcgttctggtttccaataccacggtcgagtagcagcgctagcagattctgctcgcgaagctggtctgaaattctaaggtagggttggaagatggctaaagaacaacaagttcaagcgaatgatttgcaagaaaaattaatcgcagttaaccgtgtttctaaaacggttaaaggtggtcgaatcatgagctttactgcactgactgtagttggtgacggtaacggtcgtgtaggtttcggttacggcaaagcccgtgaagtacctgctgcgattcaaaaagcaatggaaaaagcacgtcgtagcatggttacgatcgcgctgaacgaaggtactcttcaccacccagtgaaaggtcgccattcgggctctaaagtttacatgcagcctgctgcagaaggtactggtgtaatcgcaggtggtgcgatgcgtgcagtacttgaagttgctggtgtacacaacgttttgtctaaagcgtacggttctactaacccaatcaacatcgttcgtgcaacgattgatgcgctagtagacgttaagtcaccagaaatggttgctgctaaacgtggtctaactgttgaagcgatttcggagtaagaacacatggcaactattaaagtaactcaaactaaaagctcaattggtcgcctgccaaagcataaagctacactgcgcggtttaggccttcgtaaaatcaaccacacagtagaacttgaagatacgccatgtgttcgtggcatgatcaacaaggtttactacatggttaaagttgaggagtaatcataatgttattgaatactctatcaccggctgcgggttctaaacatgctcctaagcgtttaggtcgtggtgtcggttcaggccttggtaaaacaggtggccgtggtcacaaaggtcaaaagtcacgttctggcggcaaagtacgtccaggttttgaaggcggtcaaatgcctctgaaacaacgtctaccaaaattcggcttcacttctcgtaagagctttgtgtctgctgaagttcgtctgtctgaactggcgaaagtaactggtgacgtagttgatctgaacgctctgaaagcggcaaaccttgttactaaaaacatcgagtttgcaaaaatcgttctttctggcgagatcaacaaagcagtgactgtaaaaggtctgcgcgtgactaaaggcgctaaagctgcaatcgaagctgcaggcggtaaaatcgaggaataatctcgaggattgaggtacagatggctagaaaaccaggacaagattttcgtagtgctcagagcggcttaagtgaactgaagtcgcgcttattcttcgtaattggtgcacttttagtattccgagccggctcttttgtgccgattcctggtattgacgctgctgtacttgccgaattgttcgaacagcaaaaaggtaccatcgtagaaatgtttaacatgttctccggtggtgctcttgagcgtgcatctattttagcactgggcatcatgccgtatatttcggcgtcaattgttgtccagttgctaacagtagttcatccagcgttagcggaactcaagaaagagggtgaagcaggccgtcgtaagataagccaatatacgcgctacggcacgcttgtacttgcaacattccaagcgattggtattgcaacaggcttaccaaacatggtcaacaatctggtcgttatcgaccaaaccatgtttaccctgattgcgaccgtgagtttagtaaccggtaccatgttcttaatgtggttaggtgaacaaattacagagcgtggaattggaaacggtatttcgatactgattttcgcaggtattgttgctggattgcctaaagcaatcggtcaaacaatcgagcaagcgcgtcaaggtgaactgcatgtacttcttctgctgttaatcgcagtgttagcttttgctgtgatttacttcgttgttttcatggagcgtggtcaacgtcgtatcgttgtgaactacgcaaagcgtcaacaaggtcgtaaagtgttcgcagcacaaagcactcacttgccgttgaaaatcaacatggctggtgtaattcctgcgatttttgcgtcaagcattatcctgttcccaggaacattggcgcagtggtttggtcagaacggcgaaagcagcacattcggttggctaactgatgtgtctttagctttgagcccaggccagcctctgtatgtaatgctttatgcagcggcgattatcttcttctgtttcttctataccgcgttggtgtttaacccgcgtgaaacggcagataacttgaagaagtctggtgcattcgtacccggtatccgcccaggtgagcagacagcgaaatacatcgataaagtaatgacacgtttaacccttgcaggtgcactgtatattacttttatctgtctgatccctgagttcatgatggtcgcttggaacgtacgtttctactttggcggcacatcactactgattgtagttgtcgtgatcatggactttatggcacaggtacagacccatttgatgtctcatcaatatgagtctgtgttgaaaaaagcaaatctgaaaggctacggccgttaatacggcaggcagttcagatagatttacggagtttagcaatgaaagttcgtgcttccgttaaaaaaatctgccgtaactgtaaagttatcaagcgtaacggtgtcgttcgcgtgatttgcagtgagccaaagcacaagcagcgccaaggctaattagcagaaattttttacttgaaaattaaggtagtgtcgagtatattcctcggcctaccttttgcgtgcaaaagaagtagtataccgcaacgtatcctcgacgggctttgttgcgggtaattctttgatgaaagtactaggagtgcatagtggcccgtatagcaggcattaacattcctgatcataaacacgctgtaatcgctctaactgcgatctacggtatcggcaaaactcgttcaaaagctattctagctgacctgggtattgctgagagtgttaagatcagtgaactaactgaagagcagatcgatcaactgcgtgatggtgtagctaagtacactgtagagggtgatctacgtcgtgaagtttccatgaacatcaagcgcctaatggatcttggttgttaccgtggtcttcgtcatcgtcgcagtctaccactacgtggacagcgtactaaaaccaacgctcgcacccgtaagggtccgcgtaagccgatcaagaaataatcgggaagggtagagtacaatggctaaacaaccaactcgcgcacgtaagcgtgtacgcaagcaagttgctgatggcgtagcgcatatccacgcatctttcaacaacacaatcgtaaccattacggaccgtcaaggtaatgctcttgcttgggcaactgctggtggttctggtttccgcggttctcgtaagtctactccgttcgctgcacaggttgctgctgagcgttgtgctgaaatggctaaagaatacggcctaaagaacctagaggttatggttaagggtcctggtccaggtcgtgaatctactgttcgcgctctgaatgcagctggtttccgtatcacgaacatcgttgatgctacaccaatccctcataacggttgtcgtccaccgaagaaacgtcgcgtttaacgtttctaggaagattggagaaagatcatggcaagatatttgggtcctaagctgaagcttagccgccgcgaaggtactgacttgttccttaagtcaggcgttcgtgcgattgataccaagtgtaaaattgataacgcaccaggcgtacacggcgctcgtcgcggtcgtctgtctgagtatggcgttcagcttcgtgagaagcaaaaagttcgtcgtatttatggcgttttagaaaaacaattccgtaactactacaaagaagctgctcgcctgaaaggcaacacaggtgaaaacctgcttcagcttctggaaggtcgtctggataacgtagtttaccgtatgggttttggtgcaactcgcgctgaagcacgtcagctggttagccacaaagctatcctagtaaacggtaaagtagtaaacgttccttctttcaatgttgcggcaaacgacgttgttgcagttcgtgagaaagcgaaaaagcaatctcgcatcaaagcggctctagaagttgctgaacaacgcgaaaaaccaacttggattgaagtcgatgtaaacacgatggaaggtactttcaagcgtatgcctgagcgttccgatctgtctgctgacatcaacgaacaattgatcgtcgagctttactctaagtaaggtttaaactaaagagaggacacaatgcagggttctgtaacagaatttcttaagccacgtcttgttgatatcgaacaaatcagcacgacacacgcaaaagtaactcttgagccgttagagcgtggtttcggccatactctgggtaatgcacttcgccgtattcttctatcttcaatgccaggttgtgctgtgactgaagtagagattgaaggcgttcttcacgagtacagcaccaaagaaggtgttcaggaagatatccttgagattctcttgaacctgaaaggtctggctgttcgcgttgccgaaggcaaagatgaagtgttcattacactgaacaaatcaggctcgggccctgtggttgcaggtgacatcacccatgacggtgatgtagagatcgtaaaccctgaacacgttatttgtcatttaacttctgacaatgctgcgatcgctatgcgtatcaaagtagaacgtggtcgtggttatgttccagcttctgcccgtatccatactgaagaagatgagcgtccaattggtcgtttgcttgttgacgcgactttcagcccagtagacaaaattgcctactctgttgaagcagctcgtgttgaacagcgtactgacttggacaagcttgttatcgatatggaaactaacggtactcttgagcctgaggaagcaatccgtcgcgcagcaacaattcttgctgagcaattggatgcgttcgtagatcttcgtgatgtacgtgtacctgaggagaaggaagagaagccagaattcgatccgatcctactgcgtcctgtagacgatcttgaactaacagttcgctctgctaactgtctgaaagcagaagcgattcactacatcggtgatctggtacagcgcactgaggttgagcttcttaaaacgccaaacctcggtaagaagtctcttacagagattaaagacgtgcttgcatcacgtggtctgtctctgggcatgcgtctagaaaactggccaccagcgtcaatcgctgaagattaatcgatattagttagaaggattaggtcatgcgccatcgtaagagtggtcgtcaactcaaccgcaacagcagtcatcgcaaagcgatgttcagcaacatggctagctctctagtacgtcatgaagttatcaagactactttgccaaaagcgaaagagctgcgtcgcgtcgttgagcctttgattacactagctaagactgacagtgttgctaaccgtcgtctagcatttgctcgcactcgtgataacgaagtggtagcaaaactgtttaacgaactaggtccacgtttcgctgcacgtcaaggcggctacactcgtattctgaagtgtggtttccgtgcaggtgacaaagctccaatggcatacattgagctggttgatcgcccagaagctgctgttgaagctgctgctgagtaatcagttcgtcatgcaataaaagagccgggctagcccggcttttttatttctattttctgctttatctgggtgtgaaaagtgggtgttgtgctttttcacactgtatctcgatttcacactgtatatcgatagtgggcatggcattactgccatagcttacctaatgacgccaataggtcttgactcgcaccttgctgagtcaggtattgcatcaaaacaggcacgaactgttcaaccatgctggcatccagtcctaatgtattaaaggcttggttcacttctttgcgttgcaaaattgtgctgaggttttgatttgggataagaccattcaaatcattaaggtttgggattaattggagcaactcgcttttttgatcggcatttaggttgttttgagcctgtgcaagcagggtcgctacgccacctcccgcttgttgcggtgaaagaggaaattgactggtaaattgagtcaataactcttgggttgctttggattgggagagggtttcaccaactaatccagcgaggtcgtttgaacctaaagatttgaggtcagggaaagccagagcggatgtgctggcgagcgtcgaaataagtaaggcagtaaaacgatagtgcatgatcactctccataaatggcgcgtaacgtattttcttattcggttcgaaggttcagatcgaaaccttggatgtgagatagtttaatgaaaaaagagcgacccagtgggtcgctctttgtcacataattgcgaaagcgaaacttacaggatatccagcagttcgacttcaaatactaacgctgcaaacggaggaatcgctgcgcctgcgccacgctcgccataagcaaggttgtgtggaatgtagagtttccacttagaaccaacaggcatcagttgcagagcttcaacccaaccgcggatcacgccagtcaccgggaattcagcaggttggccgcgtgatactgagctatcaaacacagtgccatcaaccagttggccgtggtagtgtacgcgaactgacttatcggatgttgggattgcgccattaccttcaaccagtacttcgtactgcaggcctgactcaagaaccgtcacttctggacgtagagcattatctttcaggaaagcttcaccttcagaagcggccactttagcggcttcttggcgggcttcttcagcacgcatatgaatcgcatgtagagcttggttgatctcatcaatagaaatcgctggctgctcgccaacaagagcggtggcgatacccgcagcaattgccgctacgtttaagccttcaaggccactacctgccaactgttgacccatttgtaggccaatgccgtagcttgctttctgttctacggtttcaaattttacttcagacataaaagtcactcttggtcgttcaataaaggcgacagaatagcaggttagatagagtgatgaaacgtttagcgcccaatcgttgctatccgttcggtgtgacttatcgcagaaagttcagcgaaaaacttcaagtttgtgtcaagctttggctttcatgtcactcgactctatactctaacctcatgaatttttatactgtgggcaagtaattaaaggactttgaacatgaaccgccgccacaagaagccgcagcaaactgattatctggccaaagtgcagaattattggcagcaattggattggccacgctatcgccaacaactgcatgcgttatggttgcgcttgcctccttttcatcgtcgtggcttgatggtgctcacgcctgctgtgttggtattgatggtgatccctttgccggacaagcaagacgtggcggctgaaactcctgccacgtcaaagcggattgaggttgggatcaatacgcaaagcttgagtgaacaacgcacgcaagcgcaaaccgcccttaaatcttcggcatggcaagagtacgtggtgcgtcagggggatactttgtcccaggtgtttcgtaacaacgagctaccactcactgatattaatgcgctggttaaggtggaaggttctgataaaccgctgagccaaatccaagccggtcaactgatccgctttaaattggcggaaaacggccaattagacattttgcagcttgaacgtaataaccaatcagtgatgttcttccgtctctctgatggtggctttgggcgcagtaagtaattcccaccactttgccagccatgcgctaggcaacagaggcagaataatcattccaatcccaagccaagtcagtgcgtccagcatttcagcaaaccagaatgcgccaaaagccgcaacaaagatcaatcctgaacttgcagcaatccataaccactgagataagctgagcggctgccaataggcggccgccagtaagccggaaatggggagtgaaaaaagtgtggtccacataagtgtggtcacgacaggttggcgctcagggatggtgcgagcgagtaggttaaagagtgccaacgaacatgccgtacccaaggcaaacagggctgcccaatgaaattgcgacgggcgcaagacaatcagtaccccaagaaagccggtgacggttgcgataaccttgccgcggcttggtctctctttcagaaacagaattgagagaggcagcatcaatagtggcgcggcgtaaaacaccgcattggcggtggctaagggtaaatacgaaatcgcgaccaccatacagccagcgcccagtagcactaaatgagcgcggattagggtgactttaggatcattcagttgacgtaagactttgggctgttttcgccacacgggccagatgagggcaaaagcaaagagttggcgcaagaacatatattgaaaaggtacgacttcaccttgcagcattttgactgccacatcagagagcgaagccgccaaattgcccagaaccagtagccaaacagctaacgctacagggttcatggttaggctcttttcatatcaatgtgaggaatgccatcttctagatagatttctgaggttgcgacaaagccatagcgagcataaaactcgcgcagatgctcctgtgcaccaatttcaatcgattgttgtggccataagttttgacactgctcaagtgccgtttgcaatagttggtgtcctaagccattgccacgtgcactggccttagtcgccacacggccaaggctaacactaggatagctcaccccggccggcagtagacgtgcgcaagcgacgagctctccatcttgataacccagcaggtgatgcacttcgttgagcgtatctttgttatccaattccgggtaggggcaggtctgctcgaccacaaaaacatcgacacgcagtttgagtagttcgtacagctgttgggtggttaattggcaaaaagggatacattgccagttgatcatctttatctccttaaatatgaaatctatccacttcctatgagaagctgcaactgcaagtcatttgagtatgggcggataggaatagcagtactgtagcaggcagcgcaaaaaccagcgttaacaaaggttaagggcaagcaagaaaatttaaatcaagattcactggagctcgggcgcaaaataacgataatagcgcttcttttttcgtcacactgaggacaccccttgaacgccaactcttttgctgctttgaatctgaagcctgaacttcttgctaaccttgaaaccatggggtttgccactatgactccgattcaggcgcaatctcttcctgcgatccttaaaggtcaggatgtgattggccaaggcaaaacaggctccggtaaaaccgctgcgtttggtcttggggtactctccaacctcaatgtgaagcgctttcgtgtacaagccttggtgctgtgtccaacacgtgagttggccgatcaagtcgcgaccgatattcgtacgctagggcgtgctatccacaatatcaaagtgttgacgctgtgtggcggcatgccgatggggccgcagatcggatcccttgagcatggcgcgcatatcttggtcggaacgccgggacggattttggatcatttgagtaaagaccgtatcgatctcagtgagctcaataccttggtgttggatgaagcggatcgcatgctcgaaatgggcttccaagaagcgctggaggcgatcattgctgctgcgccagccgagcgtcaaaccttgctgtttagtgcaacttaccccgctagtattgagcagattgcgcaaagcgtgactcgcaatgcgctgatgattaaagttgaggcgacccacgatacttcaagcattcgtcaatacttctataaagtagaaggcagtgctgcgcgtgatgaggctctggaaacgttgcttttacaccatcaaccgacttcttcggtggtgttctgtaacactaaacgtgaagtacaaaatgttgccgatgccctgcatcaaagcggctttagcgtgattgaactgcatggtgatatggagcagcgtgagcgtgaccaagccttagtgcaatttgccaataagagtatttctattctggtcgcgaccgatgttgcggctcgtggtctggatgtcgataaccttgatgcagtgtttaactacgatctgtctcgcgatcctgaagtgcatgtacatcgcatcgggcgtactggtcgtgcgggaagtaaaggcttagcgtttagcttctttagtgacaacgagagctaccgtgtggcgcaaattgatgagtacatggatattgcgattgagccttcaaccttgccgcaacctgctgcaggcgctcgtccttacgcggcgaatatggtcaccattcagattgacggtggtaagaaagacaaggtgcgtcccggtgatattcttggcgcgctaaccagtgatggtgaactgactgcggagcatatcggcaagattaacctgttcccgatgcgtgcttatgtagccgtgcacaagaaaatcgccaccaaagcactgaataaaattgccaacggtaagatgaagggacgccagttccgtgctcgcttactcaaataatcttacgcgtcctgtctcagccgcgctttaatgcggctgaggctaattggtgtgatccccaaatacgcggcgatgtgatgatcgcaaagccgcgccatcaaatctggaaactgagtacacatcacttggtaacgctgttctgggcgatagagcaacataaagcgctctttttgctccttgtacagcagttgcgtctcaagtaagcgttgatagagcgggtgaccgctagagcgccattcacgtaacacttcaatcggtacgcccatcagttgtactggagataaggtttccagcatgaagggtgaggcttgctcacgcagcaaactttcaaaaccaatcgcccagtcttgctcccaataaaactctttactgaaacttttgccctcttcggtgagataacaagcgtggcatagccctgcgagcacccaataggcaaagggagtggtttcaccttgcgcgaccaatacatgtcgcgttggcagctcgagtggctgagcgacactttgcaattgcgcgcattcggcatcggaaaaaccatgctgttttagataagcgtgaaactgtgcttgcataaaagcctcatagaaaagaaaacagccactctaggtggctgtctactttacgtgataacccaagcgacttgaagcggctgccgtattggttgccatttcaataggggcattatcggtgcttatttttgtaagtcgatgcgatacactgcgaagccaacatcatcactggcgactcgggtcatcggatattgacctttttgtttaataaactgggtggctttatcgcttggtgaggtttcaaagcgaatatccagcttggttttgctgctgatcggagcaaatgaccagttgttgtccgcacttggcgtcacttcgcctttgtccttactcacgcgagcgatgtaatcggccactaccgtgcggttttcatcgggggaatcaaacgcgacaaactcagcgcctgtgccggggaatttgttgctgtaggcacgatagttgttggtggcgatcaagaaggtttgttgggtatcaattggcttaccttgataagtcagttgcacgatgcgctgtgaatttgggttgatcagtttgcagtcaccatcgtagcgcgcaggctgagtcacatcgatctggtaattgacgccatcaatcacatcaaagttgtaagtgcggaagccatcccagttgatgagcgattgcggtgcgctagacgtcacatcaatctggttaaactggcctgctgagcactctaaccactctttaagctgctgaccgctcactttcatggtgactaaggtgttcgggtacaggtaaaggtcggcggcattacggaaagtcagctcgcccgcttccacttcagtgaaaccgttaggatcgtctttacggccaccggctttgaaaggcgcagcggcagatagcactggcaaaccatcaaggtttggatcgccttgaataaagcgctcgacataatctttctgcgcgaggttgacgatttgtaccgttgggtcatcttgcaccagtgataagaagctgtacatcacgtcgttcgctttgccgattggctggttaacaaagtcgcatgtaccttgatgatcgtgttgcagcgcttgcaccatagtggcatcggcttcgacaagcgctttcttattggctttgtcaaagattgggcgagcttcggattgaccggaagtcactgcccagcgaccttgctgcttttctaaggtcagatccatcaccccaacatggctaccccaacgccccggcatcacagcggtcacgccattgatggtacctttatcgatgtctgcgcccggtacattagcaaaatctttacccgggaagacggcgtgagagtgaccaaaagcaatcgcgtcaatacctttgacttgggtcaggtagtaaaccgagttttctgcgccagcttggtattcatcggtgctgatcccagagtgggggatggcgacaatcacatccgcgcctttggctttcatctcagggataagtttttctgcggtctgtttgatatcggctgcggtcactttaccttcgagatttttcttatcccacaccatgatttgtggcggaacaaatccgatataaccgaccttgatggtatgtgcctctccatcggtatctttaaagctgtgctctttaatcacataaggcgtgaataagtgctgacctgttttggcatcaaacacgttggcgttgatgtaggggaaggcggcatcgttgatggtctcttttaaaaactcaaggccgtagttaaattcgtggttacctatgttacccacatcataacctagcggattcatggctttataaacggggtgcacttcgccagccttgatgcctttcgctgccatgtagtcacccatcgggctaccttggatcaaatcaccgttatcgaccagcacactgttttcgacttcggcgcgagcttgtttgacaagcgtggcggcgcgcgtcaggccaatttgatcggaggctttatctttgtagtagtcataatccatcaaattggtatgaatatccgtggtttcaacaatacgtagtttgatcgtatcggccattacagggcccgccatagctaacaggccgccaagtaccgctaaagaaacaggtttgatcatcatggtcatcacagactccagaatgagtgacagaaggaggaaataaaaacaactcgataaatgtaacaaaagtcgatgaaacaaaggtttcactcataaccaaattgtgatgtgacgcgatacctttgtctgaaattgcccggttgatcccagttggcatgctgctgttgtcctgactgtgtcgagtaatctgctgagcttaggcttttatgcccatttcgctccgcttatatcagcttttggaataaaaaatgaaattatagaatttcaggtaataaccgtaactgctcataatgcctgcaacagaccaattaaggatcaagattatggcgcaggatgcggtaactccccttcgtaaaacccctcgcttagccgttgtagaaggctcaggttatgtgcgtgccgcgcgtagccaactgcaagcaggagaagtggcgctggtgggcgcaggccctggtgatcctgagctactcacagtcaaagcactcagttatctccaacaagcggatgtggtgctctacgactacttagtgtccgatgaaatcatggcgcttatcccaagtgagacgattttagtctgtgtggggaaacgcgcaggccatcacagtgtgccgcaggagaaaaccaatcaactcttggtcgattttgcccgtcaaggttatcgcgtggtgcgcatcaaaggcggcgacccttttatgtttggccgcggtggtgaagagttagaagtgctgtttgaagctggcgtgaaatttcaggttgtccccggcatcaccgcagccgctggtgcaacggcgtatgccggcattccgctcactcatcgtgattacgcccaatcggcgctgtttgtcaccggccatttgaaagcgcaagccgaggatctggattggtcaacgctggcgcgtggtaagcaaactttagtgatttacatgggcttgagcaacgctgcggcaatcgctgaacagctccagttgcatggccgtcaagcgagcacgcccgtggcaatcattgaacgtggtactcaagtcaatcaacaggtgctgattggcacattgcaaactttgcccagtttagccagccaagcgcaatctccggcgctgattgtggtgggtgaagtggtcgcgcttgccgccaagctgcactggtttggcgaacaaggcgcaacacagcagcttgatgcagcgcagtcagcgtaaggtgcagcacccatcttcttggtcactacttaaaatttcacactacggcgctgcttaagggcagtgcgccgccgtcaggcaagcgaaaaggaagcaggtaaaatggatcaacagcgtttaacccatttaaaacagttggaagcagaaagcatccacatcattcgtgaagtggcggccgaatttgataatccggtgatgatgtactcgattggcaaggattcatcggtgatgttgcatttaacacgcaaagcgttttatccgggcaagatcccttttcctttgttgcacgtcgataccgactggaagtttcgcgacatgattacgtttcgtgatacgacggccaaaaagtacggctttgatctcatcgtgcataaaaatccagaaggtttggcggcggggatcaacccatttgatcacggctcctctaagcacaccgacatcatgaaaacccaaggcttgaagcaggcgttgaacaaatatggctttgatgcggcctttggtggtgcgcgtcgcgatgaagagaaatcgcgtgccaaagagcgtgtctactcttttcgcgataaaaaccacacttgggatccgaaaaaccagcgtccagagctatggcgcacctataacggccagatcaacaaaggtgaaagcattcgggtgttcccgctctcgaattggacggagctggatatctggcaatacatctatttggaaaacattgagattgttccgctctatctggcggatgtccgcccagtcgtgcagcgtgatggcatgctgatcatggtggacgatgatcggatgaagctgcgcgaaggtgaacagattgagcacaagagcgtgcgttttcgcaccttaggctgttacccactgactggagccatcgagtcacaagccaatacattgaccgagattattgaagagatgctggtggcgacctccagtgagcgccaaggccgcgcgatcgaccacgatcagtcgggatcaatggaactgaaaaaacgtcaaggttacttctaaggatcgaaggaaagcgtatgaacaatgcagtcaaagagcagctcgctgagctcggtattgaaggttacctcaatcagcatcaacacaaatcgttactgagattcttaacttgtggctcggtcgatgatggtaaaagcactctgatcggtcgtttgctccacgattcaaagcagatttatgaagatcaactggccgccgtccataacgatagccagcgggttggcaccacgggcagtcgcccagacttagcgctgctggtggatggtttgcaagctgagcgtgagcaaggcatcacgattgatgtggcgtatcgttatttctcaactcagaagcgcaaattcatcattgccgatacaccggggcatgagcagtacacgcgtaatatggcaacaggcgcatcgacttgtgatctggcggtgatcttgattgacgcgcgtaaaggcgtgctggatcaaacgcgtcgtcactcatttatctccaacttacttggcttgaaacactttattgtggcggtcaataaaatggatctggtcgattattcgcaagatcgttttgaacagatccgcgcagaatatcttgagttttcaaagcatttacagggagagaccgagattcagatcatcccgctttcggcattggaaggcgataacgtggtcgaaaaaagccgtttgatggattggtatcaaggcccatcactgcttgagctactggaatatgtcgatattgatcgcgacaagagcagtggagcgtttcgcttccctgtgcagtatgtgaatcgtcctaacctcgattttcgcggtttcgcgggtacgattgcttctggagtggtgaaagtcggcgataaaatcaaagcgctaccatcgggtaaaacctcaaccgtgacaaggattgtgacttttgatggcgatttgcctcaagcacaagccggtttggcggtcactttgacactggctgatgaaattgatattagccgtggtgacttgattgtgctggaaagtgcgcaagtcgacagcactaaccatttgttggcggatgtggtgtggatgacagaacagccactgcaagtggggcgtgattacgatattaaaatcgcgggcaagaaaaccgtcggtcaagtaaaagcggtgcgtcatcagtacgacatcaataacttgtcgacctaccatgccgagagtttaccgcttaatggaattgggttgtgcgaatggacgtttacccaaactgtcgcgctggataaatatctggattgtgccgataccggtggtttcatcattatcgaccgcctgacaaacgtgaccgttggtgcgggtttagtgcgtgacagtttgcaaaatatcactggccaaaccgagtcgttttcagcctttgaacttgagctcaatgccttggtgcgtaagcacttcccacattggcaagcgattgatttaagccgcttaggtaaagcgtgagtgaggatggatgagtaagcaagcagatagcctgggctttgagcaagatgccaagccagagaatgtggtgtggcatcgtcatgcggtggataaagcgcaacgtgcgacactgaaacagcagcgccctgcggtactctggtttaccggtttatcgggtgcgggcaaatcgaccgtggcaggggcgcttgagaaccgtttagcggcgcttgggtatcacacttatctgctggatggtgataacgtacgccacggtttgtgtagcgatctcggcttttctgaacaggataggcgggaaaacattcgccgcattggtgagcttgccaagctgatgtcggatgcgggtttgattgtgctgaccgcgtttatttcaccccatcgcgctgagcgacaaatggtgcgtgacttgttgccaaatggcgagtttctagaggtgtacgtcaacacatcactcgatgtgtgcgaagcgcgtgacccgaaaggcttgtacaaaaaggcgcgcgccggagaaattcgccaatttactgggattgattccgcctatgaagcgccgctcaatccggatatcgatttaccggcgggtgaaaaaagcgtggatgagttggtggcgcagtgcctacaggcgttagcagagcgtcatatcattcaacgttgggtataactctttagattcaaaataaaccaaaagcgaccatccggtcgcttttttgatctctttattgagagcatatcatcagacggtgtggtgaatcgagctgctgctcacttcagtctgtacggtgaatttctgagtcagaagtgcgaccagctgatcgtaataagtcatattgggtttgttaccgagcagtcgacacagttcattgccggttgggctaaaacgataatagatcaggcgcacgcctttgctggttggctgcagatgcagatttttaccctgatagctaaggagtagggcgggttcggcttcaatctcgcccgattccaattccgttgcgtgcaaaagacccagctcaatcaataccaacaagctggaataaggcagttgatgattgcctatattgatggcttgggtggtaatgcgcttgccgagactaaacaagctattttgcgctttgtagccaatcagcaatttcaagctggtgtctgagccaaaactgcacgccagcgcggcggcgcgttgtaaaatctgcgcttctttgggcgtcatatcctgcagtaccttcagtgctttcatggaggtaaagccgggattggtcacttcacgtttcagcacttgcgcccacaggcgctgcatggagctattgtgaatgtcctgcgccatatcaaaaaagcgatatagccaatcttggtctgggtcgccagcgctttcattacggcaagagctgtgcgcaagcttaatgatctgctctaagtttttctggcgctgctctttacgttgtcgctcgcgatgtactgctcgttctaatgcgctgttttccggcgattctgttaatagctgggcatctaagccgtgatgacgggcgataaccaaaatgcggctaccactgtctttgacataatgggagtgggttcgtttctcttggctctgttgagagtcatgctcgatcacaacaggcgtcatattgtccgccatgcgcttcctgaaagcctctgctgcgtttttggtctgctgtaaaatttactctgttcgccgctgagcagccagtgaaactctctgacgtagtgcacaattttgtgctatcacaaatgataataaattgttaaagttgttattggtctttgtggggtggctatgaagtattggaaagagcgcaaattggccaagtacctatcactattaatcttatttatcggctatttctcggtactggcgtatctatcgaaatatttggtgtaacctccccgcgcaagcgcagggagggcacagcgttttctctctgcggttacatatcgtcgtattcggcgatctcagtaccaataatggtgtaagccgtttccgctagatcatgactgagtgattcggttttcaattccccaatcacataaatcacatcccacagctcttggatcggagcacctttaggaaacttgacgtaaataatctggttaggtggcggtggtggcacgtgaatacacgcaccaaagtaaggcaccaataaaaactcggtgacctttttatcatcgccttcaagcgggatcacaaagccggggattttgacccgactgccgttcagctccttacggaccgtgccaatctgttgctgcttggctggttcattaccgttatgatccggcatcggcataccttgttgatcaaacaagttgcgctcattttctggaatgagatcgagccagtcgagttgtaacacatcctgctcactggcagtggtgtcttgattagccaatagtggcgttgagaacagcggcgccatgatgaggctcgctatcaacataaaacgtttcatcgaatgcttccttgtgatccttctcgttgtgagtcagtcacctattttattcctataagcgaatggtcatgccatcactgagcgattgtcgataagcgcgcagtgcgggaataaagccaatcactatacctgccagttgtacgcagccgagcaactgccattcataagcggttaacccagccagcgcaatttgaatgccgtactggcttgcaatcagtggcgcggcgagcgccagtagcagataaagcacactcacgccaagcaggatgcccacgagtgtcagtacacttgcttcgctgaccagcaaagcaaacacatgctgtggccttgcgcccattgcacgtaagatcgacatctctctgcgccgctcttgtaagctggtcagcaagctactgagcatgccgagcaaccctgctaccaccacaaaaacggagacagccatcagtgcttgttcagcgacggacatcataccccacagttcatgcagtgctacgccgggcatgatagcgctgagcggctcttgcggatagtcattgatttgccgctgcagggcaaaagtttggatttttgatttgagtccaaccagcatggcggtgatttgcttaggcgtgaaatcacgctgtgccagttgttcggcgctgggttgatggccaagattggcaccggactcccaaccgacatggatcgcctctatcgcttctaaggaaacatgcacagttttatcaactggggtgcccgtgggagccaaaatgccgaccacagtaaagggcaggttatcgtggcggctaaagccgacatcactgatgccatgggcgatgataatttggctgccgacttggtagccaagcgcttgggcgacatcggcgccaatcacggtttcaaataacccattgaactctcgcccttgggacaaagtcagtggttgcttacttccgtaacgataatgttcaaaatagctgtgattggtgccaagtacgcgaaatcctttatgtgaatcacctaaagagatcggaattgcccatttcacggcagggtgctggctaaattcttggtaacttttccaatcaatattgttggtggcattgccaatccgaaacacagaatagagcagtaaattaacttgcccagagcgtccgccgacgatcaagtcggtaccggaaatggtattggcaaaactctctttcgcttgagtgcggatgcgctctaccccgagcagtaacaccacggcgatagcaacggttaacacggtgagcagagccgttgctttgcgattgagtaggcttttccacgctaaattcaggataactttcattgccaacctcctgcacgattgagagtaggtaagtgaacacttcgctcaaaaagcttttccagtgttgggtcatgactaacaaaaactaaagtggaaccgactcgctccgcttcttcacgcagcagagcaataaaagcttcacggttatcgtaatcgagggcagacgtgggttcgtcggcgatgatgagttgcggctcacccatcagtgctcgcgccgcggcaacgcgttgctgctggccgatactgagttcggtcacgggtttattcagtaaagcgcttggcagatgcaatctttccaacagtgattgcgctttgtgcgataagggaccatccacttgctgtttacgcaacgcggaaaagtggcatggtaaggtcacgttatctaacaccgacagataaggcagcagattaaattgttggaaaatatagcctatatggtcggcgcggaagcgatcgcgctgactggcactcaagcggcttaagtcactgccaagtaaagagacgacaccttgtgttgcggtattaatgccggttaaaaggctaagtaacgtggacttgccgcagccactggggcctttgacaaacaggtgttcaccccgagcaatctgtaaatgggcaatatccaaggtgggtgagctggctcccggccaacagaacaccacatcattcaactcaatcacggatgaagtaggatcagaacggtgagcaggcatcatggctcctcatgtgtgcagggaaaatcaaagcatctccaatgagggataggtgagagtcacctatcccgagcggtggcattacagtttgataagcgtttgcttagcgttcagttgtagcgcactttgctgcttttccgttaacacattggcttggattttctctgtgcttgggaaatattggaaccattgggtatcgatctgtttgagctgatcgacggcttcacagtggaactgatattgagcggtgaatgagccgtgttgatgctcatcatggtcatgcccttcgtgctcatgtcctttatggtcgtgttctttgtgatcatggtccgcatgttcatcagcggcatgatcatgacctttatgatcgtggtctttatggtcgtgcgccttatggtcatgctcgccttcaccgtgctgatgctcgtgttcttcatcttcaccataagcgtggctgtgttggtactcttcgccacctaaagtgtgtttaatcaacacttcacgtttttcgcactgtgctttatcactgagtgcaaatagcttctctgggtgatgcaaggtctctaaggctttttcgagtgcttgtttttgcgcgtcatcttgaggggcgtgttcaaaaccgactacatcggctcccggtgcggtgatttccagcagcaggtcatggccatcttgagcaatgttcagttcaacttggccatgcacatgagcctcgtgctgacgatgttgatggtcagagtgatgatcggccaatacgttgccagaaagtgtcgcgccaaccatcagcgcaatcattgttgggtaatgcatgaaaaactcctaataaaacaaaaaaagaaactatcggtttgatttgttttatgccgcaggtggtgaacgagcgaaataggagtgcagcacttgagtgcgttggatcggttgttcaacccttgcttgtggtggattttgacgccaactgggcaatatccactgactggtttttaggccatgtgccgcgctggcaaacaactgacaatcatgctgtaaatgatgttcaggatgcagatcaagttggtgatcaatcacggccacgttaaaccaaagcgccagcaccacagaaagcatagccactatggataagcgagttggacgtagctgaggtaacgacatagcgtgtgcgaccaagagtgattgaaaaccgacagtgattgaggcttgttataatataacaagtcacaaatcaggcaagcgatgattctgatgagtttgtatgcagatgtctctcagtcaacgggtgagcaagttagtccttactcacccgatgtgattgatggatgaaggcatcctcttcctgcttgaagctgcagcggtgtgagctgcaacgtcaagtcgtttggggcgattacagattttgctgaatcaagcccagtacggtttgaatgtccgcttcgttgagcgccccttctttcacaaacagcacgttaccttgtttgtcttgcactatgatcgcagaggattccgcttgtagctgccaggcttgggcaacgagaccaaactcatcaagcaccatagatgaccaaggaaactcttttttgctgtcttgcgcggacgatttcacaaaagagctggtgccccaaatggcatcgtcttgattgatgatggtggtggtttggtaactctcggctgggaatttcgcggcggtgatcgcggccatcagtggcgcattcatctcttttgagctgctacgtcccgcaatcgcttgaatgacgcgtaccttgccaagtagatccgcagagcgccatttttgatagttgatgttattgtcttgtaggacgatttcaccgtgcttttcgacaccaaccgcaggtaccggtgagccgacagtcaggttgtgtgcgaaagctagagtgggagagcatgccaagagtaaggcgataagtgttttatttttcatggttttgtttcctcaagttgagcaaacaaaggtatagcacacaaatgaggggaaagagaaattcccctcattgagatgtctttagagtgtggagtgtggcgggaaacagactcctgtaccgccgagcccacaataaccattcggatttttggccagatattgctgatggtacgtctccgcgaagtaatacgctcctgcgggcagaatctcagtggtaatcgagggacgatgttgcgctgtcagcagggcttgataagccgcttttgaggcttctgcgatttcgcgctgatcttcactgaaagtgtaaatggctgagcggtattgcgttccgcgatcgttgccttgacgcatgccttgcgtggggtcgtgacgctcccaaaatgcgcggagcagttcagtcagtggcaggcgttctggatcaaaaatgacgcgcacgacctcggtatggccagtttttccactgcacacttcttcataggtcggattgggcgtaaaaccgcctgagtagccaacggaggtggagatcactccgtccagttgccaaaacaggcgttcagcgccccaaaagcagcccataccaatcaagatttgttgttgaccggattgtggcgcggcagtgagcgagctgccattgacgaaatgcgtatcgtcaatcgacatcgcagtagtacgaccgggtaaggcgttgtgtgccgtaaccatggtttgtttgtcgagcatgatgtttccttactgaagtggtggcgctgtctctttgaatatcgcaagcagcaacgccctgattatcttcgatacagaccggagatttaacggttttcgtacagacgcagggttgcattgacgttatgatgcgtctgtagcaaaaatgtcaccgttgtataacgagtctaaatcaagcatgagacgaaaatcacttcccgctttaatctcgctatggctgttttcagccgtatcttacgccgatgtgaagctcgagatcactggaataagtggcgcagagaaagataacgtggaggcgtatctctcatcgatcgcggcacaagactattccaccagtctgcgttttcaatctcaactggaaagaagtatgaccgaagcgttgaatgcactcggctactaccaccccagtatcgattttactgtctctgaagataaccagcgtttacgcgccgcagtgaccttgggcgaagtgacccgtttgagcgaggttgatattgtgatccgcggtgaagccgaaggcgatcgcgattttcaacgtttgatccgccgcagtggtttgagagtggatgcgccgcttaatcacagtctgtatgacaacctcaaatcgggcattcgtaacttggcgttgcaaaagggctactttaatggtgattttcaggccagccggctggaagtgattccagagctgaatcaagctcgggtgattttgcactttgatagcgggatccgttacctgtttggagcgaccacggtcgaaggcagtcaaatcgatgaaaatcgcgtgatgtcgctgcgccctttcaaacaaggcgagccttatttggtgtcgcaagtcggcgagtttaaccaaaatctttccaatacagattggttctcttcggtgtttgttgagccggacttatcgcagttggatgaggggcgtgagttgccgatcaaggtgaccttagcaccgcaagcacgcaatcaactggaaaccggtttaggctattccacggacgttggagtacgtggttcattaaaatggaagaaaccttgggtgaacagccaagggcacagttttgacagcagtttctctctttctataccagagcagaccattacggcgggttacaagatcccactggaagatgcgttaaatgagtactatcgcattcagtacgggatgaagcatttggacaagcgtgataccgagagcttggaatctaatctatcacttgaacgccattggcagttggatggcggctggcatcgcacggtctttattcgttatctcttagagaattatcgtcagggtttacaagatgataacagccaatttttattgccggggatgacttatacccgtacgcggactcgctccaacagtggcttactgacttggggcgataaacagacgattaccttggaatatggcgatccagcattgctttcagaaacacgggtattgcgtttacaaaccggatcttcttggttacgaacttatgcgcgcaatcaccgcgccttagttcgcgttgatggtggagccaacttggtggatgaatttgaccaactctcgccctcgctgcgtttctttgccggtggtgataacaatttgcgcggatacggttacaagtcgatttcaccgcaagatgccagtggcgctttgacaggggcgaaatacatcgccaccagctcaatcgaatatcaataccgtttaaccggcaactggtgggcggcgatgttcatggatgtcggtgatgcgtttaacgataatcctgaatggaagaaaggggtcggtactgggatccgctggatttcgcccgttggccctattcggctcgatttcgcatgggggctggatgccgcgccgggcgatgagttcaaaatccacttcactttagggcctgaattatgatcaaacgggcgttaaagtggaccaaatggctctctatgtcgctgttggtgttagtgatcttgctggtgctggctttggcgggggcgctgtttaccaaccccggtttgcatgtggttttgtggggcgcgcagcaagcattgccgcagttgaaagtggagcaagcgcagggcgcactgtttccgcgttttactttgcaaggggtcaattatgcggatagtgagcttaatctgagcttttctgtgcaaaagctaagcttggcgattaaccccaactgcttattggaacccagtatctgtatcaatgagctggcgctatctggagtcaagttagatctcccctcattagcagagagtgaaccggcacctgatgagcccgattctgagccgctgggagacatttccacgcccatcccgattcgcttaggtcagttagcgctacaagatattgaattaaatattctgggtaaccgagtggcgtggcagcaattgaccacgcgagcgtcttggcaaggcaatcgcctgcgtatcgggcaaaccgagtggcaggggatccgtcttgcgttagcggagagtgaagcctcaaccgaacctgaggcggctcaagcggccacctctgatagcgcagaacctttgcaactaccagacgtgatgatcccgctgcacattgagttagcgcgtttcgatattcgtgattttcgtttagaacaagagacgccgatcatcgtcaatcatctagctttgcaagcgactgccgcgcagcacgacgtctctatctctagtcttgagctgagcatgccggagctggatgcgcaattgaacgcacaagcgacgctcagtcaagattatcccattcagttagaactgcgcagtcaagtgcatcttgctgattttaaaggccaaaccttatcactggccgcgcagggcagtcttgcggatctcactgtacaagccaatctagactcgttagctcaagcacagttgaacagccactttaatctgctggatgccgatataccgtttgatctgcaactgagtcaggtgaaagcgcagtggcccatgttgggggaaggggattatcacgttgaggttccggagttaagcattcagggctccttggccaagtatcagttcgccttgcagggtgcgctacagggcaaagatttaccgaatgtgagtttagccctgcaagggcatggcaatctggatgaagtcgcgttgcaatcacttaaagtcgatacgcttggcggcttagtgacgggcaatgctgtggcaaattggaaaaatccgctcaattgggccgctcggttaaacctgaaaaatattcagcccggtctgcaatggcctgaagcagaaggcaagatcagtggtgagcttgatacctctggcgctttgactgagcaaggtggctggcaagtggaggtttcacgcttagccattaaaggggtattacgtgattatccgcttaaaatgttaggcgaactcagcgcctccgatgtccaaggacagggggatatcacgttacaaactaagggagtctccttagtgcatgggccgaactccctcaccgctaaaggccagttgagtaagcagtggcggatgtcggtggagttggatgtaccggatttgagtaaatccctacccgatgcaaaaggcaaagtgattggcgatgtgctgctgcgaggtgatctcaaacagccacgggtcaaattggtgctggatgccgatagcttgcaatggcaagagttaggctcgattgggcatgtcactttgcaaggaaatctcgtgccactgcctgagcctcaaggcgagctcaccttacaagtgcgcgctattcagtaccaagatcaacgaattgatactgttgatttaaaagcacaaggctctcagagaaaacacgaggtgacactcgatgtcacctctgatctcgcttcgaccagcttggcgatgaatggccgattgcgtactgaacccacactgcgctggcaaggtgagctggagcgcatgtggttaaattcaccgcaagggcaatggttattacaacaggcgaccgctctctcctttgatcagcgaacggagcgcgttaccgtcgccgctcactgttgggtgcaaggggaggcttcgctctgtttagaagaagaggccgagttaggggcgcggggtgagacgcgcttagcgattaagcagtttgattttaagcagctcgccggtgtcctgcctaaggaaaccaaactcagtggcggcttgaatggccaagtgtgggctaagtgggctccgaaagcggcgccgcagttgcaagccaatcttgagttaacccaaggtcaggtgacgcaaaagctgaataaaagcgtgacgtttggttgggataaagcgcaattttctgcccaattggcgaaaaatcagctgcaagccagttggttattagatgcaaccgataatggtgatctctcgggcaatatccaaattgccgatgtgcgtgcggagcagaaaaccatgctcggttcacttaacttaaccacgtttaatctggatttcttgcaaccgttgattggtgaacttagtgaagcgaaatccaatattaatgccgatgtacaatttcatggcccgatgctgcatccgcaattgaacggtgaaattgcgatcaatgatattcgcgtaaaaggtgagatctcgccggttgatgtgcaatccggtcaagtgtcacttaaatttaatggttatcaggcagtgttaaatgctgatatccagaccaccgatggtttgctcgaagtcgatggtgatgccgattggcaacagatagaggattggcgactcaaagcgcgagtgcatgctccctcaatgatggttgagctgccacctatggtgagagtcaaggtgatccctgatttaaccttgaccatgcaacctcaactggcacgcgtgacgggtaatatagcgctgccgtgggggcggattgtggtcgaagagttaccgccgagcgcgattggggtatcgaaagatcaaattttgctgaatgcggattttgagccactgactgacaaagagcggatcccgtttagtgtggagagtgacgtcaatgtgcaaattggcgacgatttccaactcagtgcttttggtctacaaggtaacttagtcggacgtctcaatgtggcgcaaaaggataaagggccgtttattttgggtgaggtgaacattcgcaatggtcaataccgctcatttggacaagatctgcagatcaaagaagggaagatcttgatgaatggcccggtggatcagccgtatttggcgatcactgcgatccgtaatcccaacaacacgcaagatggcgtggttgctggggtgcgagtcagtggaccctcggatgagccgtcactcaccatcttctctgaacctgcaatgccacaagccaatgcgctgtcgtatttgttgcgtggacaaaatattgatggggaagcagggggcaacgccatgaccaccaccttgattggtctgagtttagcgcagagtggtaaactggttggcgagataggccaagcgtttggtgtgcaggatctgcaactggatacggcaggttctggagacgattcacaggtcacggtcagtggttatattctgcccggcttgcaagtgaaatatggtgtaggtatttttaactcagtcggcgaatttactgtgcgttatcgcttgatgcaggatctgtatttggaggccgtctccggtgtcgacagcgccgtagatctgctctatcagttcgaatttaactaaggagagagatgtgcagcacctcgtttttgtgtatggcactttgcgtcatggagagagcaaccacacgtatttacaacacagtcagttgcttggtcagtttgaaaccaaacctgaatacgccttgtatgatctaggcgcgtatcccggattggtggaagggcatcaatcggtgcatggtgaagtctatctcgtggatgaacacactttagcgcagctagatattttggaagatgtgcccgtcgagtatcggcgtgacacgattgagacaccgtttggtaccgcgtggatctatatttatcaagagacccatcgcttacattcgctgattgattccggagattggtgtcagcgtgtctagttctgacctacaaagaaaaaagccagctgagctggcttttttatgctcaaaacgtgggcttatttgttttgcgcacgctcgtaagagctcaggatttcagcgcgagcagaagctgcatcttcccagccatccacttttacccacttgcctgattccagctctttgtaacgctcaaagaagtgagtgatctgtgctttcagcagcgctggcagatcgttcacgtcttggatgtgatcgtactctttagagatcttggtgtgcggtaccgcaaccactttcgcatcttcaccggattcgtccgtcatctttagcacgccaacaggacggcaacggatcacagaacctgggatcagagggtatggagttggaaccaaaacatctactgggtcaccgtccagtgacagagtgtggttcacgtaaccgtagttacatgggtagaacataggcgctgacataaagcggtctacgaatactgcgccagactctttgtcgacttcgtatttgattgggtcagcattggcagggatttcgatcactacatagatatcatcaggcagtgatttgcccgctggcacattgtttaagctcattaacggtttccttttctgttagccggacttcaaattcgggatttattattattcaagtttgcctatggcgcaaaatgcacccttcagcgaaggggtgagtttactctcaaaataaaggatccccaagtgacaaagagaaaaagcgccgcacagggcggcgcgaagtggcttagtctgggtaagtctctaaaaacgtttcgactttatgcaccatgttttttgagccgacaaaaaacggtacgcgttgatgcagttcggtgggtttgatgtccatgatgcgacgcgccccatccgaagcaaggccacccgcttgttcaatcaaaaatgccatcgggttgcactcatagagcagacgcaatttaccattcggatggctttgtgtgcttgggtacaagtaaatgccacctttcagtaagttacgatggaaatccgccaccagcgaaccaatgtagcgtgaagtgtaggggcgtccctcttctggcacattttcttggcagaatttgatgtactttttcacgcccgttgggaagcggatgtagttaccttcgttgatcgagtaaatcttaccgttttccggaatacgcatattctcatgcgagagatagaaggtgccaagcgaaggatcgtaggtaaagccgttcacaccattgcccgtggtgtacaccagcatggtcgatgagccgtaaatcacataaccggcagcgacttgtttattacccggttgcagaaagtcctcctgcgtcggcggtgtgccaactggcgaaacgcggcggtaaatcgagaaaatggtcccaaccgatacgttcacatcgatattggaagagccatcgagcggatccatcaacaccacgtatttggcatttttgttgagctctttactgaatgcgaccgcttcatcttcttcttcactcgccacaccacacacctgatcgcgtgcttccagtgcggctttgaatttttcgttggcatacaggtcgagcttttgttgctcttccccttgaatgttgtcattgcctgacgcgccaatgatatctgccagtcccgctttattgatttcgcggttgacgattttggcggccaaacgaattgaggctaaaagagaggaaagttcaccgctggcgtgggggaaatcatgttgtttttcaacaataaattcaccgagggtgcgcattttctgcatgttggttccttaacactattgggtcgggggtacgcccatttgttgacctaaggttagtgaagtgcaacaaacgggttgagcaagatgatgggatcctctgatggaatcgattgcgctatgcaccttgtctgtagtgaattgtaaaacttagatctttttacgggtattgaactaaccgacggagatctcactttgattgtcgaccatttcgaatttacaccacgctgaactgctgcactcgcttttgcgtagcggatcgggataatggagccattccaatcgcacagtaaaaaggctgggtttttatgcacattcatatcttgggaatttgtggcacgttcatgggcggcgttgcgatgttagcgcgtcaattgggtcataaagtcaccggcagcgatgccaatgtttacccgccaatgagtaccatgttagaggcgcaaggcatcgagatcattgaaggttttgacccagttcaacttgagcccaagcctgatctggtggtgattggcaacgcgatgagtcgtggtaatccttgcgtggaatacgtgctcaaccacaacctgcgctacacctcaggcccacagtggctacaagattttctactgcatgatcgctgggtgattgcggtatcgggaacgcatggcaaaaccactacttcaagcatgattgcttgggtactggagcattgcggctatcaaccgggtttcttagtcggtggtgtgttaggtaattttggtatttctgcgcgtttaggcgaaagcatgttttttgtggtcgaagctgacgaatacgacagtgcttttttcgataagcgttctaagttcgtgcattaccatccgcgcactttagtgatgaataacctagagttcgatcatgcggacattttcgataacttagaggcgatcaagcgccaatttcatcatttggtacgtactgtgccgggcaacggtcgcattcttgctcctaagcaagatgaagctttagccgatgttttacagcgcggctgttggagcgaaaccgagttcagtggtgagcaaggcgagtggcaagcagaaaaaattaccgccgatggttctcaattccatgttttgctgaaaggcgaacgtgtaggtcaagtgaattggagcttggtgggcgatcacaacgtcagtaatgcactgatggcgattgctgcagcgcgtcacgtcggggttgctccagagctggcttgtgaagcgctggggctgtttgtcaacaccaagcgccgcttagagctgaaaggtgaaatcaatggggtaacggtgtacgacgattttgcccatcacccgacggcgattgaacttacgctcggcggtttacgtaacaaggtgggcgataagaaaatcatcgccgtacttgagccgcgctctgccaccatgaagctgggcgtgcacaaagaaaccttggccgcttcgttgcacagcgccgattcggtttacctttaccagccgtctaacattccttggtcggtggaagaggtcgcgaaacagtgtcaacagcctgcgcaagtgagcgccaatatggatgaatttgtggctatgattgccaaagaagcccaagcgggtgaccagattttggtgatgagtaacggtggttttgaaggcattcatggcaagttgctcgcggcactgcaacagaaataatttaaggtgagcatgaacaacaatcgaaccattacactggcttggactggcgcttccggagcgccatacgggctgcgcttattgcaatgcttgttagcggcggactatcaggtgtacctactgatctcttcggcggcgcgagtggtgctggcgactgagcacggcttgaaactgcccgccaaccctgaagcggcgcaagcggctttggtggagcatctgggctgcgccagtgataagttggtggtgtgcggaaaagaagattggttttcgccagtggcttccggttcggctgcccccaagcagatggtggtgtgtccatgctcggcaggcagtgtagccgcgattgctcatggcatgtcagataatctgattgaacgcgccgctgatgtggtgctgaaagagcgtggacaactgctgttggtagtacgtgaaacgccattctccactttgcacttagaaaatatgcttaagctctcgcacatgggcgtgactatcatgcctgctgcgccgggtttttatcatcagccacaatcgattgacgatctggtcgattttatggtggcgcgcattctcgatcatcttggcatcgaacaagcgctcgtaccgcgttggggctatgatcaacgcgtgcgcggcgagtaatgacatggccagtcgcgattttccgctactggctaattacaagatttcccattacaatccaacccactcacggggggccacccattcatccgaatggcgctgagatcaagcactgcttgggacccgcaatgactgcgatgttcgcggttgaacctgaaccagataatgctggcgtaggaattgagctaggtttgcagaatggaataatggacgattctctgcctccctcaagcctgtgccgctcattaaggagagcgagccttgaaatttcaactgactgcggttgcgttagcaaccctatgtgttgcctctgcagcgtctgctgcaccaaccctcaccgtttacacttacgactcttttgccgccgaatggggccccgctccagcgattgaaaaagcgtttgaagcacaatgtggctgcgatctgcaatttgtcgctttggatgatggcgtgtcgattcttaaccgtctgcgtttggaaggcagcaacagcaaagccgatgtggtgctggggctggataacaaccttatcgaagaagccaaacagaccggattattggcaacccacagtgtggataccagcaaggtgactctgcccaatggctggagtgacaacacgtttgtgccttacgactatggctatttcgctttcgtctataacaaagagaagctggctaacccgccaaccagcttgaaagagctggtggaaaaacgtgatgatctgaaagtgatctaccaagacccgcgcacttcaacgccgggacagggtttactgctgtggatgaaatctgtctatggcgaccaagcgccacaagcgtggaagcagctggcgagcaaaacggtcaccgtgaccaaaggttggtcagaagcttactcgatgtttctcggtggagaggcggatctggtgctctcttacaccacatcgccggcctatcatttgattgcagaaaatgatgcacgttttgccacagcgaatttcagcgaggggcattacctgcaagtggaagtggccgccaaagtcaaaagcactaaaaatggcgagctggcggacaagttcctgcaatttatcctgagtaatgagttccaaagcgtgatcccaacgggtaactggatgtatccagtgacggcggttgaactgccaaaagggtttgatactttggcggtaccgacacaatctctttctttcagcgcacaggaagtcgcgcaaatgcgtaagccatggattcgtgagtggcagcaagcgctgagcttctaaggttaagcgttgaatcgaactcctcaattaggcttttgggtcgcggctggtgtcgcgacctttgtcctcgcagcattagcggcgctgctctggcaatcgccaccgttcaatctgaatctgatctggcaagatgcctattatcggcatgttacccagttcagcttttatcaagccttctggtccaccgtgctcagtgtggggttggcaattccggttgcccatgccctcagtcagcgccgtttccccggtcgtgatttactactgaaactgttcgcgatgacgctggttttgccggtgttggtggcgatttttggcttaatcgcgatttacggtaatagtggttttttggccaaaacgctgcacagtgtcgggttcccgctgccgttttcgatttatggtttaaacggtattttactcgcccatgtactgtttaatttgccttatgccagccgtttgctgctgcaaagtttagaagcgatccccagtgagcagcacaagctgtgcgcccatctcggtatgagtcgctggcaaaagtttaagtgggtggaatggccgcgtttgcgtcagcagctgccgcacgttgcgggcttggtgtttatgctttgctttactagctttgcaaccgtgatggtgctcggcggcgggcctaaagcaaccaccattgagctcgcgatctaccaagcgatcaaattcgatttcgatctgcaaattggcgcgttattggcgatttggcagatgttgctgtgtactttactgacttttaccttgcagcgtttttcgcattcccgacccatgaacagtgctgcgagcaaggtgactgagcgttgggtacgtgattcatggcgcgccaaagtttgggatgcgagctggattgtcgctgcatgtgtcttggtattgccaccattagtgatggtggtgctggcagggctcaattcaaagctaggcaaggtactgacgagcggcgatttttggtcggcagtcagccactctttgcaagtggcgagcttagccagcagcttggctctggccagtggaatcgcgatgttactcaccagccgagccttgcggttgaaagcggcccatcgccgcgcgaatggcgtggagtggatcgcgacgttaattctggtgacgccaggattagtggtgagtaccggactctttttgttgctgcgtaatatcaccgatgtgtttcgtttggcttactggattgtggtcgcagtcaacgcgctaatggcgctgccttacgtcgtaaaaaccttgagccaacctatgtggcacttggcacagcaatatgaattgctgtgcgccagtttaggcatgtctggttggcgtcgatttcgtttagtggagtggcgcgcgctgcgtaagcctctctcccatgcgtttgcgatcggttttctgctctcgatgggggatttaagcgcaattgccctgtttggtagccaagattttcgcactctgccgctctatctttatcaactgctcggcagctatcagatggataccgcggcggtcgtcgcgttggccatgctgatcatgagtgtgggttggttttatgtgattgagcggctgtttgcccagcgtccgcttaccaaatgctaatgaggaaaagcatgttagctctagataaagtgcgttacgaatatgagcacgaatggttcgagtttgatctgaacgtggctgatggcgacattgtggcgctgatgggacccagtggcgcgggtaaatctaccttgctcagtctggtggcgggatttattgaaccggtgagcggcagcatcaaggtcaatgatcagtcggtactcggtttagcgccttatcaacgccctttttcgatgctctttcaggagcacaacctgtttgcccatcttaccgtgcgtgaaaacatcggcttaggtttacatccaggcctcaaattgaacgctgagcagaaacagcaagtggttgatgccgctcagcaagtaggaattgccgactacctagatcgtttacctgagcaactttccggcgggcaacgccagcgggtggcactcgcgcgctgttttgtgcagccgaatccgatttggttgcttgatgagccattttcggcgctcgatcctttgctgcgtgaagagatgctcgctttggtaaaacagttagccagtgagcggcagcgcactgttgtgatggtgacccaccatcttagtgatgcgcgtgccatcgccagccaaatcgcatttttgagccaaggtaaagtgaaggtggtgagtgattgtcaggcagtgacagcgcagcatcctcatcctgaactggctcagtttgtggcagcggcactgaatgagccgaaataacgctgagtgaacggatatacatcgaccgtaaagaaaaggttagcttgcgctaaccttttttgatgctgttgcttaatacgagatggcttgcggcctcgcgttttattccgctgaatccagatcgtcttcactctcttcttcgatctcttgttttgccaacatcgcttctttcagcagttggaagatctcgcgagacgattttggcggcttgttgcccgctttttctttgctggcttgacgcgctaacagacgcagacgttgacgatccgcttctgggtattgctccatcgccacttcaatcgcgctatccccttcggcaacgatgcgatcacgcagttgctccagtttgtgcagtaatgcagtggtttgcgagtgcttgttacgcagcttatccagtgccgcttgcagtggctctgggtcaatatggcgcatcagtttgccaatgtattgcagttggcggcgacgagcttcgtttttaaaacgctgtgcatctttaatggcttcggccagatcttctggcagcggaaatttggctaacgcggaaggctttagctccaccagctcttcgccgagcttttgcagggccagcatgtcatttttcaattcggttctactgacccaaatgatctcttcttcctcttcccaaggggctttttggtttttacgtgccatattcttcatcatgatgagttacttatgtcggctattttagcaagaatcgtggggagaaagcgaaattcttgttatcctaataacatcaataaccaatggttgaatgaaatatggatgtaaaagagcgagttgcgctgcagcgtcaagagctggaagctgcggttgctaaggcattagagcttgcagcggcgagttcggatgcggctgaagtggcgatcaccaagagcacgggattaagtgtttcgacccgcatgtgtgaagttgaaaatgttgaattcaacagtgatggtgcacttggaattaccgtttaccgcggtcaacgtaaaggcagcgcttcaacatcggacttgagtgaaaaagcgattcgacaaaccgtattagccgcgctggatattgcccagtacacttcggccgatccttatgctggccctgcgccgaaagaattgatggtgcaggagattcctgatcttgacctcttccatcctgatgagccgaatcccgatgtcgcggcgcaaattgccattgcggcagaacgtgcggcgttaggttatagcaagaaaattaagcaaagcgatggcggtagctacgatagccattacggcgttcgtgtttacggtaacagccacggtttattggctagctatgcctctagtcgccacagcattagctgtagtgttattggtgaaggccgcaacggtgaaatggagcgcgattacagctacaccgtggcgcgtcaccgtgacgatttatggacgccagaaagcgtgggtttgcaagcggcggaaaatacggtgagccgtctggatccgcaaaagctgaaaacgggtcagtttccagtgatgtttgcggcagatgtggcgacaggcttaatcggtcatctggtgatggcgatcagcggtggcaacttatatcgcaaatcgagtttcttactcgatcatcttggcaaaaccattctgccgacgtggttcaatatcagtgagcgcccgcatgtgatgcgtggtttggcttccagcccatttgatagtgaaggggttcgtactcaagatttggaaatcatcaccgatggtgtactagcgacttacttactgaccagttacgccgcgcgcaaaatgaacatgacgccaactggtcatgcgggtggcattcataactggtatgtgaaatcgactggtcaaaactaccaacagatgctcaaagagctgggtaccggcttactggtgacggaagtgatgggacaaggtgtgaatgtggtgacgggagattactcacgtggcgctgctggtttctgggtagaaaatggtgaaatcaaataccctgtttctgaaatcaccattgcgggtaacctcaagcagatgttgcagcagattgtcgcggtgggcagtgatatagaaacgcgctcccagatccaaacgggttctattttgattgaatcaatgaaggtcgcgggcgagtaagctctgaaccattgaatgaaaaagccgacagaaagtcggctttttgtcgcatcaatttgggaaatcggaaactaactggccagcagcaaagtggctagaccgagaaatacggataaaccaatcacatccgtgacagtggtcagagccataccaccggcaagagcggggtcgatgttcatctttttcagcaaaataggaatgctgactccagcaatgccggccacgatgaggttggtcatcatcgccgcggaaatgatcccgccaagcatccattcacctttccacactacgacgatggctccgatgatcaatgcccaggtaatgccattcagtaggccgattgccgcttctttcatcagaagttcgcgcttgttactgtcaccgatgtgaccgagtgccagcccccgaatcaccagagccacggtttggttaccggctacgccgcccatggatggcactatggtcatcagcacagcaaccgccgccatttgttcgagagtcgcttcaaacatgttcgacactgaagccgcagcaagggcggctagtacgttggccccaagccaaatactgcgtttgcgcgccgatttgacgacaggggcgaaagtatcttcatcatcatccatacccgccatactcatcatcgagtgttcggcgtcttcacggataatatcgaccacgtcatcgatggtaatacggccaaccagatgttggttttcatccaccacaggggcagaaacccagttacgccgttcgaacagattggcgatgtcggagtctttcatatcgactttgatcgcttcgtccgcatcgtccatcacttcactgaccggcacatccggttgggtggtgagcagagtgacaagagaaagatggccaatcagtttgctttcatcatcaatcacatacagcgcatcggtggcttcggggagttcgcctttcatacgtaaataacgcagtacaacgtcgacgtccacatcggcacggatggtgatcacgtcggtgttcatcagaccgccggcggtatcttccggataggacagagcggtttcgacccgcatgcgatccgcggcatccatttgggacagaacttcgcgtgacacatcatccggcaagctacgcaatacgtaggcgacatcatcgatgtccataccttcggtcgcttcggcgagcttctccggtgccattttcgacaccagcgcgtccttaacgtcttcattcagctcgtcaaggatttcaccgtaatcttctgggtcagtcagttgccacaacacctcacgcgctttacgtggtgaggcttccagtagatgagcaatatcttctggctccatgtcctgcagttggcggcggacatgaacaaagcggccattatctaaggcttcagtgatttcttggagggtgaggtgagcttggtcaaattcgatctgctcggccatggcttccccctaggttggaattggaataatggtcagcatggtaacttaatttacccgcttatttaataagatcttagtaaggaataaggatttctttactcttctttgccttgatagggcaggccgatggggcgtcgcgataggtggctagtgaggagctttactcatcttcatcaaatttttgttcgataagctgacaaaccgcttgtagagcttgttcggcttgcgagccttcggcggagatcaccacgttttgcccttgtgccgattccagcatcagtaaccccatcacactgtcggcggttgcttcacggccatcttgactctgtacagtcaatactgcatcaaaggattgagccagttgcaccagtttaaccgctgcgcgcgcatgcaggccaaggcggttttggatcagcacggtttggcttagttgcggcataggggctcctaggattgctgtttttccaatgaagtatggcggagctgtacttgatgaccaagttgcgcgaaatattcacccaactgctgcgtcaggtagaccgaacggtgcttgcctccggtacaaccaatggcgatggtcaggtagctacgattatttttctcaagcatgggaagccagtattcgaagaatttttggatctgctgtttgagttccatcacttcgctatgaccttccaagaaagatttgatcggagcatccagtcctgtcagcgggcgtaggtcaggttcccaatggggattggggagaaagcgcacatcaaacacgtagtcggcatcggttggtaaaccgtacttaaagccaaacgactgaaacaccatcacaaggtctttgcgctcacggccttcaatgcgcatacgcaccgtttcgctcagctcatgcagcgactggttactgctgtcgagcaacaagtctgcctgctctttgagtgggccaagcagctgtttttctaactcaatggcttgggcaagtgaaggcttgctttgactgagagagaggggatgaatgcgccgtgtttcactgtagcgtttgagcaaggtctctttactggcgtcgagaaacagcatgctgacatcgttgttctgcttgagctggtcgagtacatcttgtaccaagcttggctctttgggcagattgcggatatcaatgctaaccgccacgttttgttgactgccttgaaccgactggataaaggctgtcagcaggctgacgggcaggttatcgacacagtagtaaccaaggtcttcgagtactcgaagagcgacgctcttaccggctcccgattgtccgctgaccacgatcaaacgcatactgtttgcctgctattggttaaccatgatgttgtacagctcttgatcgctggctgcgttacgaagctgtttgaggatctgtttatcgttgaggcgttctgccatgcaagcgagggtttttaaatgctctttgcattgatcttcagggactaaaagagcaaataagagatcgactggacgattatcaatcgaatcaaattcaatcggctcttcacactgcaatagcacggcgacggcgttttcgctgtcggacatgcgtgcgtgtgggatggctatcccgttaccaataccggtactgcccattttttcgcggcttaacatgcactcgaacagttcggtggcattctggccagtatgcagggcagcgatttcgctgatgatttctagtgctcgtttcttactagaacattggactgcacttttggtgcagtccaatgaaagtacttcgctcaattgcatgattaatgactacttagcttttctttatgcttattcaattgtcgaaccaatttatccaccaaactatcgatggcggcatacatgttttcatcgtccgcgtgggcgtgaatttctgcttggtttacgtggagcgtagcttcggcgatctggcgcagtttttcaacacgtaaaatgacttgaacgtgattaatgtggtcgaaaaaacgctcaagtttgtcaaatttggagtgaacatagtcttgcattgaatcggtaagatcaatgtggtggccttgaatgttgatttgcatagactttccttctctagtttaggcctatagcaggcgtttgcgctgacttgatggggcgatgccaagtgattcacggtatttggcgatggttcgccgcgcgacttggatgccttggtcagcgagtagggttgcgatcttgctgtcactgagtggtttggcaggattctctgccgccaccagttttttgatcagcgccctgatcgcagtggacgagcactctccgccattgtcagtactgacgtggctggagaaaaagtacttcaactcaaaaatgccgcgcggggtatgcatgtatttctgcgtggtgacacgcgaaattgtcgattcatgcatttccaccgccatcgccacatcgttgagcaccatcggcttcatcgcctcttctccatactcgaagaaatcgtgttggtgttcaactatgcacttggcaactttgagcagtgtctcgtttctactttctaaacttttgatcagccattttgcctcttgcaaattggtacggatgtagttgctctccgcattattaccgcgcatcaggtcggcatactgctgattgatcttcagtttaggcacactatctgggttgatggtgaccagccatcgaccttgttctttatagactgacacgtcaggtatgacgtattcagcgtgatcttgggcaattcgactgccggggcgaggatcgagctgttggatgagttgcaggatctcgcgcaagtcctcttctttgagcttagtctctttcagaatggttttgtaatcgcgattccctaaatcatcgatgtactgtgagagcagtaaacgcgcttcttccagccaaggagtatcacagggataggtggtgagttgcagcaacaagcagtcttgcagattaagcgatgccacaccaaaggggtcaaactgctgaatgcgtttacgtaccgcttcaatctcatccaactcaatgtcatcactgcgcaggctctcttggatctcctctagtgagacggttaaataaccgtaatcgtcgatagcatcgataagtgcgacggctatagtgcgatccacatcgctaaagggagttaagtcgagttgccagtgaagataatcttgcagggtttgggtggtttcgccttggtagataggggcatcatcatcgagtgccagtcctgtactgccagtattggcgctgtagacttcatcccaagtggtatccatctctaattcagcgctgatttccgatttttcaatcagatccgagctatcctgcggttcaggttcgtagagttcttctggctcgcgcgggctttcttccgtcatacgtacgctatcaagcgatggcgcttcgtcttggttctcttccacctctaacaaggggttagattccaatgcttcctgaatttcttgctgcagatccagcgtcgaaagctgcaacagacgaatcgcctgctggagctgcggagtcatggctaactgttgacctagcttgagctgtaatgacggtttcatgcagtaatggatgccttgttattgttagtattcattgaactctactctgttttaatcatagacggaattgttcgccgagataaacctgcttcacctgttcattattgagaacatcttgtggcgttccttccgcaatcagtcggccttggctgacaatatacgctttttcacacacatccagcgtttcacgtacgttgtggtcggtgatgaggacccctagaccgcgatcgcgcagatgttcgatgatttttttgatatcgatgaccgagatggggtcaacgccagcaaaaggctcatccagcaagataaattgtgggttagccgccagagcgcgggcgatttccacccggcgtcgttcaccgccagagagcgccatcccagcacttttacgaatgtgctgaatgtggaactcttcgagcaaatcttccagcttgtcctgacgctcttcatgggtcagctcttcgcgggtctgcaggacggccatgatgttgtcttcgaccgagagtttgcgaaagatagacgcttcttgcggcagataaccaatgcccatccgtgagcggctgtgcattggtagaatgctgatgtcgttgtcatcaatggtaatggtgccttcatcgcgcgcgacaaggccgacaatcatgtaaaacgaggtggttttacccgcgccattagggccaagcaggcccacaatctgtcctgactcaacttgaagactgacgtcagaaaccactttacgctttttgtagctcttggctaaatgctgtgcttttaagatggccatagttactcttggattgcttgtggttgaagaacggtagagacgcgccctttgccatcactatcggcaatcagtttctgcaagctgattttgtagcggattttgctgccgcgaatttcgctgtcatcttgtgacaacatggctttattgatcatcactaactcatcgtcgcgaactttgtagtagagctctttggcttcaccatacagggttttgccttcatcagtcagttgcgagaaggttgcgacgttgccatagccttcaatttcttcaattttgccgttttcagcattacggatcacgatcaacttgtcggcattgatgttgatgctgccttgcttgagtttgacatcgcctaagaaggtgacacgattgctcttcatatccagttgttgactgtctgagtcgatataaactggttgttctctgtcggtagagagtgcataagcctgagtcgaggcgagcaaacaagcaataagactaaggtgtgagcgtttcatatctaccttgtacttggttataaagttcagccgaatgatcggcaaagttgcctttcatcgcttgaccgtgtgtttcaaattgtgggccgcgcagttcgacgggcttatcggcccagaagtcacgacttttgagttggatactcatctcgctggtggtgagagtatcaaagccggagtctggaagtagatttttagccaaaacgtcgtcatataaggtcagcacctgatctttgctcagaatgcctctgcgtgcagtgatttcccactcttgtaatgtaccttcccgatacactttgagtatcggagctttaaacagggtattgccgcttttcgcatagtgatccagatgaatcgaagtgatcacgtagttgcggataccttgttcgtcatacgaaatattttctaagttctcgccactgaacataggcaactccaaattcggagccacctgaatcttactgtcttgctcttgtcccaataagtaatagagtgaccaagaagcaataaacaacagcagaacgtaaacaatgcgcgacaaactcataggctcaggcctttatgaacatccagttcgttacgcgcttgcaaaatcaaatcgcacacttcgcgcacggcgccgtgaccgcctttgatatgcgtaacgtaattggcacgttgcgccagcagtggatgaccgtcggccacacacacacgcagtgccaccttttccataacaggccaatcgatgaggtcatcaccaatgtagccggtctgctcaggagcgatcgccagtttctgacaaatatcataataagcctgcactttatcatcctgaccttgatagatcagtgaaatgcctagcgctttcatgcgattttcaacaatttgtgagcggcggccagtaatgatcgcgatttcaatccccgcattcattaacgctttcacaccataaccatcacgagtgtggaaggtttttaactcttcgccttggttacccatataaattaagccgtcagaaaacacaccgtcgacatcgcaaatcagcagtttgatctgtttggcaatctccagcagtgaaggttccacttctccatacaaggttgagacggttgaactcattacatcactccggctttgagtagatcgtgcatgttcagtgcaccgaccaatttattattttcaacgagcatcaggccattaatgcgtttggcctgcattaaattcaatccttccacggccagcaaattgggctgagcaacggttggttggcgcgtcatcacatcggcaatcacagtgctgtgaatatcgatgcgtttatcaagaatgcgccgtaaatcaccgtcagtaaaaataccgagtagtgtgtcttgttcatcgacaatggctgtcatgccaagccctttttgactgatttcgagcaaagcatctcggatcaaggcttgtggtgccactttaggcagtgcgtcaccactgtgcatgatgtcattgagtttgagcaagagtttacgcccaagtgcgccacctgggtgagacaaagcaaaatcttctgcggtgaaaccgcgtgcctgcatcagagccaccgccaacgcatcgcccattacgagagtggcggtggtgcttgaggttggcgcaagctctaacgggcaagcttcacgcggtacggtgatttgcagatggatatcggccaatttcgccatattggagttggggttgcctgtcatgctgatcacgcgaatactcaagcgcttgagcacgggaagcagggcgaggatttctgatgattctccggaattagagatggcgagtacgatatcgccacgttcaatcattccgagatccccatgtgaagcttcacccggatgtacaaaaaaggcagacgttcctgtactggctaaggtggcggcaattttcttaccaatatggcctgatttgcccatccccatcaccacgactttgcccgtttgattggccaaaatcatcgcacaagcacgcgcaaaatcgtcattgatatactgctctagctgttgcaatgcatggatttcggttgctagcacttgtttagcgaccgtttggtaatcaaatgaatggggcatcctcatcttcctctttagtacacggcgatattcatgaacggagatattttctcacttagatgttcattaataggtaagtaatgtaaccgatgaaagagcacagtaggagtgcgccttctaagcgagtgatttgacgttttttgcccaaagcgaccccaaccaacagcaaagagacaccgagcatcacccaaaagtcacggctcatggcttcagggctaagcagagaagggttaagtaaacccggtaagcccatcaccgctaaaatgttgaaaacgtttgagccgataatgttaccgaccgccatatcatcttcgcctttaagcgcgcccgccaatgaggcagccagctcaggtaagctggtgcccaccgcaataatggttaagccgatcaccagatcgctcatcccgaaatacttggcaatcaccaccgcgttatcgaccagcatgcctgcgccaataggtagcagaatgaggccgactacgacccaaaatgctgctttggggttactgactccaaccggaatctccgattcttgttcatccagcaaagcatcgccgttttgtttctctttgcggctcacttgcagcatgaccaaaataaaggcggcaaacagggcgatcagtaagatgccttcatagaaaccaaggtgattgtcccacaaaattgcaccggcaattagggtcacaccaatcatcatcggcagttctcgacgtaataccgcagagcccactgagagcggtttaacgatcgcggtgatacctaaaatcaacgcgatattggcaatgtttgaaccgaggacgttacccacagcagtatcggttttcccctctagggctgcggtggcggaaaccatcatctcgggtgctgaggagcccatcgcgaggatagtcataccgatcactaaaggagagatgccaatattgcgagctaatgccgcagatccgaacaccaatttgtccgcgccccaaactaggattgcgagaccgataaacagaaagaccaccgcttcaataagcatgttgattcccacgtaataaatgaaaataaaggccaaaggcttggatgcaccatgactatacccttcctacttgaagctgcagcggtgttggctacgttcgttcactccaatcacagagtctatctatgctcatggggactcactcacttgccgcctacctgcaactccaagttgtttgggtataagagtctcgactcttagagcaaggcaaacacctccatcaatggacgaattcacgcaaggtcaggcatcttcagccatttaggcagagaattggccgccaattttgacgtgttgggtattaaaagggaagtcgaagttccaattaattatccttatccccttgcgattttgcctgtttgtcacagtaaacgtcagcctttaaagcttgttcctaggttgtcgtcggcatgctatcgactatgctggatgaagacttttatcgggtttttagacgcaaaatgagttgaacgactttgacaattcttggtcaagaacccaagcatggattgatgcgtgcttttaattgcaccatattgtgcattatcatgcgcattctttcaggatgtcgacctaacagtgaagtgcccatatgtctcaatctgacttagtcaccatcaaaaatttgcgtttttcgcgctcgcagcgcgtcatttttgatgacatagatctgcatgtccccaaaggtaaagtgacagcaattatggggccttcgggaatcggtaaaaccacactgctgcgtttgatcggcggtcaactcctgccagaacagggagagatctggttcgatggtgaaaatattcccaccctcagtcgccgcaaactgtatcgtgctcgtaagaagatgagcatgctgttccaatcaggcgcgctgtttaccgatcttaatgtgtttgacaatgtggcttacccattgcgcgagcataccgaacttgatgaagccatgattaaaaccttggtgctgctgaaattagaggcggttggactgcgtggtgctgcgtatttaatgcctagtgagctttcaggcggtatggcgcgccgcgccgcactggcaagggctattgcactcgatcctgagctcatcatgtatgatgagccgtttgtcggacaagatccgatcaccatgggtgtactggttgaactgatccgtaaccttaatcgagccttgggtgtcacctctgtggtggtatcgcacgatgtaccggaagtgatgagcattgcggattgggtttatctgttggccgatggtaaggtgattgcgcaaggttcacctcaagcattgcgcgacaaccctgatccgcgtgtacaacaatttttatgcggcgatgcagatggccctgtgccatttcgttttcctgcgcagccgatagaacaggagctgtttagtgctaaatgatgtgatgcgatgggtcagctctgttgggcaacgcacgctggcggtcagtgaaacttttggccgcgcaagcttaatgctgtttggtgcgctggtagggcgtccgcagccgattcgccattttccgctcctcgttcgccagttatacagcattggtgtgcagtcactggcgatcattatcgtctctgggctctttattggcatggtgctcagcttacaaggctatgtgattttggtcgattacggcgcagaaaccagcctaggccagatggtggcgttatcattgctgcgtgaattaggcccagtggtcacggcactgctgtttgctggacgagcgggctctgccttaaccgccgaaattggcttgatgaaagccaccgagcagctgtctagccttgaaatgatggcggtcgatccactgaaacgcgttattgcgccacgcttttgggcgggagtcatctccatgccgctgctggcgatgattttcatggcggtcggcatttggggcggccaattggttggagtggattggaaaggcattgatcacggcagtttctggtcagccatgcaagcttcggttgaattgggccaggatatcggtaacagcaccatcaaatgtgtggtgtttgcgtttaccgtgacttggattgctctgtttaacggttatgacgcgatcccgacttcagaagggatcagccgagcgaccactcgcaccgtagtgcactcatcactggccgtacttgggctggattttgttctaaccgcattgatgtttgggaactgatcatgcaacaaacacgaaaaattgaattttgggttggcagctttgtcatcgcgggaatttgcgcgattttagtgatgatttttcaggtcgctgacgtcaaaggccttggctccagcaatacttatcgcctgaccgcggagtttgacaatattggtagcttgaaagtgcgctctccagtcaaagtgggaggcgtggtggttggacgcgttgagtcgatcgcgctgaacccgaaaaatctattaccgacagttaccttggcgatcgacagccagtttaaccagtttcctgaaaactcaagtttgcagatcctgacgtcaggcttgattggggaacaatatttgagtttagtgcccggatttgtgtttgaagatgaagccatgctgaaagagggcgatcgcattgaagacaccaaatccgcattagtattggaagatttgattggccaagtgctgtatagcgtgggtggcggatcagacaaagagaaaaaggaataagtgatgtggaaaaaagcgctactcctcgcgagtaccctgttaatgccttggcttgcgacagcggccaccattgataccagcaacccttatcaaatgatgaaagcggtggctgagaagtcttttgatcgtctgaaaaacgaacaacccaaagtgcatcaagatccgcagtatctcaaagtgattgtggaagaagagttgatgccatacgtgaatgaacaatacgcggcgcttaaactgctgggacccaatcttaaaggggccaaacgtgaagatgtggcggagttcgttaaagcgtttcgcgcttatttggtgacgaattacgcgcaagtgcttacccaatacaccaatcaaaccattgagtttgggccagaaatgccattggaagaggatcgccgcatcactacagtgaaagtggaaatccttgatgcgccgcgtccgaatatcaaactggaatttaaactgcgccaagagaaatcgggtgagtggaaagcgtttgatatgattgctgaaggcatcagcttactgtccagcaaacaatcggaatggagcggcaaaattcgtcaagaaggtattctggctgtagcgaaagagttggaacagttagcgaatcaaccgatccgttttgagagccaaaagcaatgagtcatccacaatggtctgccgagaatgaacaccagttcagtttaattggcgaactggatcgagaaacggtacccaaattgtggatctttctcaaaaattggcagccgcaagtgaagcaaatcgagctttctttgcaacaagttgtcagaattgactctgcgggaatggtgctgttaattcacttaatagagcatgcaaaagtgagaaactgtcatataatgctcagcttcgtgccagaacaactgcgcacactgtttcagttgagcaatattgaacatctgatgtctcaacacatagccaaaccagcagaggtgaattgtggatagcgcacaagtccaacaaattttacaacaagctcttaatctcgaagaaattcatgtcaaaggagagggcagccactacgaagtgatcgctgtcgatgcttgttttgccgatatgagccgcgtgaagaaacagcagatgatttatgcccctttaatgggttacatccaacgtaatgatattcacgcggtcacaatgaagacgtttaccccacaagagtgggcacgcaataagaagttgatgtccctttaaggtttttatggaaaagtttcgagttattgggtccacgcagccactccaaggcgaagtgaccatttcaggcgcaaagaatgccgccctaccgattttatttgcttcaattttggcggaagagccagttgaagtggccaatgtgcctcacctacgtgacatcgataccactatggaactgcttgagcgtttaggcgcgaaagttgagcgtaatggctctgtgcatgtggacgccggtccaatcaaccaatattgcgcaccttatgatttggtaaaaaccatgcgtgcctcgatttgggccttaggtccattggtggcgcgttttggtcaaggtcaagtttctctgccggggggctgtgcaattggtgcccgccctgtggatctgcatatccatggtttggagcagcttggcgcaaccattaccttggaagatggctatgtaaaagcccacgttgatggccgtttgcaaggcgcgcatattgtgatggataaagtgagcgtgggtgccacgatcaccatcatgtgtgccgcaaccttagcagaaggcactaccgtactggataacgcggcgcgtgaaccagagattgtggatacggctatgttcctcaataaactgggtgcgaaaatctctggtgccggcacggacagcattaccattgagggcgtagaacgtcttggcggtggtaagcatgctgtggttcccgatcgtatcgaaaccggcaccttcttggtcgccgctgccgtatcgcgtggcaaaattgtttgccgtaacactcatgcacatctattggaagcggtcttagctaagcttgaagaagcgggggctgagattgagtgtggcgaagattggatcagtttggatatgacagggcgtgagctcaaagcggttacggtacgtactgcgccgcacccaggttttccaaccgacatgcaagcgcagttcacactgctgaacatgatggcgaaaggcggtggcgtgatcactgaaaccattttcgaaaaccgttttatgcatgtacctgagttaaagcgcatgggtgccaaagcggaaatcgaaggcaatactgtgatttgcggtgatgtcgatcgtttaagtggcgcgcaagtgatggcgaccgatctgcgtgcttctgcaagtctggtcattgcgggttgtatcgccaaaggcgaaaccattgtcgatcgtatctatcacattgatcgtggttacgagcgaattgaggacaaactctcagcgcttggtgccaatattgagcgtttccgcgactagcgttaaactcctcattcatgaatgggccgaaatccaagggtttcggcctttttcttccagtgccttcggagaagttgcatgattgcgttattgcgaatcttggcagtggcagtgttcgctgtctatatgtttgtgtttggctgcggttactgtttgttcagtccacgtaaccctaagcatgtttatacctttggtaagcagtttgcggcgatgtcgaaagtgttcggcattaagcttgaataccgggctccggccgatgtcgatcagcgtggtcagcacatttatattgctaaccaccagaataactgggatctgtttaccgtttccaaggcggtaacgcccaaagtggtcaccgtcggtaagaaaagtctcgcgtggatgccactgtttggtcagctttattggttgacgggcaatatcctgattgatcgcgccaacaaagccaaagccaaaggcaccattgatcaagtggttgattcgatgaaacagagcgatgtttcggtgtggatgtttccggaaggtacgcgttcgcgtggtcgcggtttattgccgtttaaagcgggcgctttccatgcggcaattggtgcgggtgtgccgattattcctatcgtgtgtagctcgaccgataagcttaaattcaaccgttggaacaacggccatgtgattgtcgaagtgttgcctcccatcagcaccgaaggctacagcaaagagaatatccgcgagctgtcacagcactgttatgatctgatgaaagccaaactggcacagttggatgccgaagtggctgagctgaaccgtaaagcctagccgcagttttgatcaaaacgaataaaaagaaagggttgccactggcaacccttttggtatttgagatccaatcaaatggattacttgcgtactgcgatcgcttcgatttcgatgcccacatcttttggcagacgtgccacttcaacacaagaacgcgctgggtagtgcgccactttatgctcatcaaagaatgcgccgtacacttggtttactgtgccgaagtcgttgagatctttgacgaatacggtcattttcacaatgtcaccgacggttaggcctgaggcttcaaccacggctttcacgttatccagtgattggcgagcttgcgcagcgatatccgcaggaatttcacctgtggctggattcactgggatttgaccagacgtcagtaccatgttgccaagatcaacaccttgaatgtatgggccaatggcagccggagccgcgtcagtatgcagaacttttgtcatctttcttatccgttagtggttcgaaaatcgctgttcagtttgcctgtaaagctttggtaggtaaagcgccgagctctcatttatccctatcttgctgacagcggttaagcttcgatttccgtgaccacatcgcgcgcaaacactttttcgcagtatttgcattttaggcggatgtcgttgttcttctcagaaagcttaaagctgctttccacaggctcattgtgtgaaatgcaattgctgtttgggcaggcaaacacattgttgatgcgctctggcagttgcagcgccaacttcttcaccacttcgtagttttcaatttggtttacagttgcgtgtggcgcgtacagcgcgagtttgttggcttgcgcttcactgatgaacacattttcaatcttgagcagatctttgctgccgagggcagaagacggcagattaaggccgatggtgacacgctgcgcggagttgtgcatatcaaacagcttcagcactttaatccccactttggcgggaatgtggtcaatgaccgtgccgtttttgatcgcttcaacttgtaatttcgtctctttgctcatgattgctctccttacagcgattcgttcaaaactagagccagcaaggcttcacgggcataaactccgttttcaacttgctcgaaatagtaagcgtgtggggttttatcgacatcagtggtgatctcatccacccgtggcagtgggtgcagcactttcagattgctgcgcgcatcgctcaggtgagcggccgtcaagatataggccgatttgatatgtgcgtattccgactcatcaaaacgttctttctgtacacgcgtcatgtacagaatatccagctctgggatcacgctttccatatcgctgaacacttggtatttcacacctgcttcatccagctcttcacagatgtagtctggcatcgctagggcttccggtgccacaaagtagaagcggttgttatcaaatttagccagagcttgtgccagcgaatgcacggtgcgaccatattttaaatcaccgacgaacgcgacatcgaggttatcgagacggccttgggtttcgaaaatggagtagagatcgagcagggtttgcgatgggtgttggtttgaaccatcaccggcgttaatcactgggacgccgttagaaaattcagacgctaaacgcgcggcaccttcttgcggatgacgcatcacaaaagcatcaacataagaggagatgacgcgtactgaatcggctagggtttcgcctttcttcgctagtgacgtgttgccgccgttatcaaagccaatcacgctgccaccgatacgttggattgctgtctcgaatgagaggcgagtacgggtggaaggttcaaagaaacagctggccacgaccttgtgcttgatcagctctggattcggttgtgccttcagttggcctgcggttttcacaatcaactccaactccgcgcgtgagagttcagcaatggagatgatgtgcttttggtaaagcgaattcgccatgatcgtcttccctatattttctaacagccataaaaaagccccccataagggaggctttaacaaatcgatgaggggaaaaacagtgaggccagtaagccaatttgcttactacgatggacactgctttgagctgcacgctgtgcaaatttcattggctacccctcagacaaacggtcggcattatacgccgaaaggctgtgagcgcaagcgattacatcacagagtcagggatattaaatcagtggcattctattgacctaaagtggcgaccatcaccgccttgatagtgtgtagtcgattctccgcttcatcaaacacaatcgagtattctgactcaaacacctcttcggtgacttccaatccttgcatgccgtatttggccgcaatctcttggcctactttggtttggtcatcatggaatgccggtaagcagtgcatgaatttgacctgtggattacctgttgctttgatgacatccatgttgacttgatatggcttcattaacgccacccgctcatcccaagcatccgcggcttcacccatcgaaacccatacatcggtataaaggaaatcacagccttttacgccttcttgaacctcttcggtcaaggtgattttggccccagtttgcttggcaatctcttggcaggttgccactaaggcatcatttggccagtacgctttcggcgcgactaaacgaatatccatgcccattttggctgcgcccaccatcagggagttgcccatgttgttgcgtgcatcgccaaggtaagcaaacttcatttcatgcaattgtttactgcgtccgtactcttgcatagtcagaagatcggccaagatctgcgtggggtgaaactcatccgttaagccattccacactggcacccccgcgtattgtccgagcacctcaacaatctcttggccgaagccacggtattgaatgccatcgtacatgcggcctagaacacgcgcggtatctttcatcgactctttatggccaatttgcgagccagaagggccgatgtaagaaacttgtgcaccttgatcaaacgccgccacttcaaaggcacagcgagtacgggtcgatgacttttcaaagatcaacgcaatgtttttgccttgcagggttttctgctcggtgcctgcgtatttggcgcgttttagctcggcagacagatccagcaggaagtggatctcttttggggtgaagtcgagcagttttaaaaagttgcggttacgtaaattgaaagccatttccctatcctcgtttggcgattccagttgcggttagtaaagcatgaaaatgctataaaagtgaataaatattttaaattaaataaagaaaaggtaagggaggatagattttgtgaggcgagatgcacataacatctcgccaaaagtgattataaattctcttcggcgaattcagccaagcggctgcgtactacgccattgaggtggatattggcgctgccttcaaagtttttgaagcgctcaaccatgtaggtaaggcctgaggtgacaggggttaaatagtgggagtcaatctgcgctaagttacctgagcagacaatcttggtgccttcaccacagcgagtgatgatggttttgatctgcgaggcggtgaggttttgacactcatcgagcagcacgaaggcgttttggattgaacgaccacgcataaagttgatcgatttaaactgaatgttggctttatcgcagatgtatttgagcgagccatcggtacagtgatcatttttatgcagcgcttctaaggtatcggtgacggaagcgagccacggcatcatcttttcctcttccgtgccgggcaggaaaccaatcgattcgccgatatcaggggggttgcgcgtgacgatgattttatcgaacattttgcgctcgacggtttgctccagcgctgccgccatcgccagtaaggttttaccactgcccgccgcaccggtcaggatcaccagatcgatatccggatcgagcaatgcgtccagcgccatcccttggtaaatatttttgggggtgatgccccaggctttgcgatgcatcatgcgttcacggctcagatcgcgcagcgtcaatttatcgccatcaatgctttcaacgcgggcggcaaagtcgctgtcttcatcaatcacatattggttgaggaaggttggatcgaatggtgcacgatccagcttatggaaggttttgccaccgagcgtgtagctcgcgacatcttccacgctgtcccaaaaactaccgggacgagtttgaaagcccttggtcagatattgaatatcatcaatcagttggtcggtgcggtagtcttccacatacaacacgcctgcacctttggcgcgcaaacgcatgttgatgtctttagtcaccagcaccacggcgcgtggtgtacgctgagcttgcaggtaaagcacggcattgaggatccggttatcgccctctttatcggtaaaggctttgacggtttcatccagttcataatcggcgaggatcgagatggttcctgttgcgccctcttgcttagaaagcgggatcccttcggtgatttcttcgggagtggcatcgtggaataagtgttccaaagcccgaatcgctacgcgtgcatcgcgcgccacatcgcgtttgctgtctttgattcggtcaagttcttcaagaacggtcattgggatgaccacgtcgtgctctttaaaagagtaaatcgcgagaggttcgtggagtaggatattggtatccagtacaaacagtttccgatcggtatcgcccataagcggctccttgctacatgtagcatgctttatcgtggatgttcacaagcggcctgtaggatcgtacgttcaggtgagcgttacgatcattgtcgacttgctgcaaacccgtgttgatactctctgtttgaacttgcaggctttgtgccaatctttttttgacactaacaccgcgccttcaacctgagtatagcaatcatcttgttaacaaatgccactcatttttgacaatttgatgtcacccaaaagctgtagaaaaaaaagcgcgtaacggcggggaatgggcgtgacctgtatcacgccatcaagtaagattagcggcctttttctacactcaaagcggtcagcatccataataaaaagctggctgaagtgaagtgtaaaaattctctgcaacgctatttgatgaggtagtccattcatgtcatttgctttagggcaacgctggataagcgatacggaaagtgatctcgggttaggtactgtggtggcgcttgatgcgcgtacagtgaccttgatgtttgcagcatcggaagaaaatcgtgtgtatgcacgttcagatgcgccggtcacccgtgtgatcttcaatgtcggcgatgtggtggatagtcagcaaggctggtcgttacaagttgaacaagtggtggaagaccaaggcgtctacacctatctaggtacgcgagtggataccgaagaaagcggtgtcgcgctgcgtgaaattttcctcagtaaccaaattcgttttaataaaccgcaggataagttgtttgccggtcaaatcgatcgcatggacaactttgtgctgcgttatcgcgctcttaccaatcaatatcaacagcacaaaagcccaatgcgtggcttgtgtggtatgcgcgctgggctgatcccgcatcagctgtacatcgcccatgaagtcggtcgccgccatgcgccacgcgtattgttagccgatgaagtcggtttgggtaaaaccatcgaagcgggcatgatcatccatcagcaagtgctgaccgggcgtgccgagcgcatcctaattgtggtacctgaaacgctgcaacaccaatggttggtggagatgatgcgccgtttcaacctgcacttttcgatttttgatgaagagcgctgtgtggaagcctttagcgaggccgataacccatttgaaactcagcagtatgtgctgtgttcactcgatttcttgcgtaaaagccgccagcgttttgaacaagcgttggaagcggaatgggatttgttggtcgtcgatgaagctcaccatcttgagtggcacccagagaagccaagccgcgaatatcaagtgattgaagctttggccgaacagactcctggcgtattgctattgacggcaacgcctgagcagttaggtcgtgaaagccactttgctcgtctgcgcttgctggatgcagatcgtttctacgattacgaagcttttgttaaagaagaagagcagtacgcaccggttgcggatgcggttactgcgctgttcagcggtgagaagctgagtgatgaagcgaaaaataaaatcactgagcttctgtctgagcaggatgtcgagccgctatttaaagcgttggaaagccacgccagcgaggacgaaattgctttggctcgccaagagctgattgacaatctgatggatcgccacggtactggtcgcgtgctgttccgtaacacgcgtgccgctatcaaaggcttccctgtgcgtaatgtgcatttgctgccattggagattccttctcaatacaccacgtcaatgcgtgttgcgggcatgctcggcggtaaactgacgccagaagcgcgcgcgatgaaaatgctctacccagaagagattttccaagagtttgaaggcgaggagtcaagctggtggcaatttgactcacgcgtcaactggctgctcgaaaaagtcaaagccaaacgcagcgagaagatcctcgtcatcgcttcacgtgccagtaccgcattgcagctagagcaggcactgcgtgagcgtgaaggcattcgtgcaacggtattccatgaaggcatgtcgatcattgaacgcgataaagccgcggcttattttgcccaagaagagggcggcgcgcaggtgctgatctgtagtgaaattggctcggaaggtcgtaatttccagtttgctaaccagttggtgatgttcgatctgccgttcaacccagacttgctagagcagcgtatcggacgtttggaccgtatcggccaaaaacgtgatatcgatgtgtacgtgccatatctgaccgaaacgtcacaagcgattttggcgcgttggtttcaagaaggtttgaatgcctttgcggaaacctgcccaaccggtcgtgcggtgtatgatgccttcgctgagcgtttgatccccattctggccgccggtggcggtgaagagttggaagtgatcatcgaagagtcagccaagctcaacaaaacactgaaatcacagctggaagtggggcgtgatcgcttgctggaaatgcattctaacggtggcgaaaaagcgcagcagattgctgagcagatcgcgaaaaccgatggcgataccaatctggtgacgtttgctttgagcctgtttgatgcgattggtctgcatcaggaagatcgtggcgagaatgcgttggtggtcactcctgctgaacacatgatggtgccaagctatccgggcctcccttatgaaggcgccaccattacttttgatcgtgacaccgcactgtcgcgtgaagatatgcacttcatcagttgggaacaccccatggtgcaaggtggcattgatttgctgatgagtgaaggggtgggcacttgcgcggtgtcgctgttgaaaaacaaagcactgccagtgggtaccatcttgctggagctggtgtatgtggtggatgcccaagcgccgaaacgcagtggcatcagccgcttcttgccagtctcgccaatccgaattctgatggatgcgcgcggtaatgatctctcttcgcaagtggagtttgaaagctttaaccgtcagcttagccctgtgaatcgtcatttggccagcaagttggtgagctcagtacagcatgacgtgcatcgtttgattacggcaagcgaaactgcggttgaaccacgagtgagcgcgattcgtgaacaagcgcagcgtgatatgcagcagagccttaacagcgagttggagcgtttgctggcactcaaagcggttaacccgaacattcgtgatgaagagatcgaagtgctggatcagcaaatcaaagagctgactggctatattgcgcaggcgcagtatcagctggattcactgcgtttgattgtggtggcacacaactgatgacgtaggccctcaaaacgagggccttgttttattccctgttggcgacattttgcgtatataatgcgccgttttttgtgatacgagacgatagcgatggcaatgaccgagtacaatccgcctaaggatccgtggattgatgtgatttatgaggatgaacacatcatcgcagccaacaagccttctggtttgttatctgttcctgggcgacctgttgagcactacgacagtatgtgggctcgtttggtggattactgccctgatgtgaaggtcgtccaccgtttggatatgtcgacttctgggctgatcctgtttgcgaaaggcaaacatatggaatcggcgttgaagaagcagttccagtatcgtctcactcataaaatctactatgcccgcgtatggggtgtgatggagcaaaatgaaggcgaagtgaatttgccgctgtgttgtgattggccaaaccgcccgaaacagaaagtctgttttgaagagggacgtgattctctgacccgctatcaagtcgtcaagcgtgaagagaaaaccacagtggtacgccttatcccgatcactggacgctctcatcagctgcgtgtgcacatgcaatcgctcggtcatccgattgtcggtgatgatctttacgcgccaccagaagccgtcgagtttgccgatcgtctgcaactgcacgctgcggagctctgtttctaccatccacgtagtcattggctgcgcactttatttgtcccttgtgacttctatcccgaagccgaggagcagattttgcagcatttcgatcctgagcgaaaattaccggactataaaaagctatcccaagactaatcttattgtgggtagcggataatcagacccggagtcagcatgtcactacccactacttctttgcctacggtcgtttttctcgaccgtgcgactattccgcgccatatctcattacctgctctgccttttgaacaccattggcttgagtatgatgcttgtgagcctcagcaagtggttgagcgcctcttagcggccgatattgttatcaccaataaagtggttctcacccgtgaaatgctgattcagttgcctaagctcaagttgatcgctatttctgccacgggcaccaacaacgtcgatttgccggcgtgtcgagatctcaatatcgcagtgtgtaatgtgcagggttatgccacgcgctctgtccctgagcatgttgtcgccatgatgttcgctttaagacgtaatcttatcggttatcacaatgatattgcggccggagagtggcagcgccataagcagttctgttttttcacgcatccgattggcgatattgcgggttcaaccatgggcattatcggcagtggtgcattaggccaagcgacggcgaatttggctcgcgcattaggtatgcatgtgctgttggctgaacgtaaaggtcaggtggaatgccgcgatgggtacacgtcatttgaacaagtgctggcgcagtcggacgtgctatcactgcactgtccgctgaccgatgaaacgcgaaatattatctcggaagcggaattggcgcagatgaaccccaatgctctgctgatcaataccgggcgcggcggtttagtggatgaacaagcgctggtggatgcgctgaaaagacgtcaaattgctggggctggggtggatgtgtttagtgctgagcctgcggatatggataacccactgattgccaaccgtgatttgcctaatcttctgctgacaccgcatgtggcgtggggcagtgattcctcgatacaacaactcgcgactatcttgatcgacaacatcagtgcatttatgcgtggtgaagcgaaaaatcgagtcgtctagcggcaacatcatcgctaaaacaaaaaggcagcgaaattgctgccttttttatcgactttttctatgaaaagcttggcttacagcgccgcgatggtcgctttctgctgctcaagtttcaccagtgcttcttggtaacccgcgagcttttcacgctctttggtgattaccgcttctggtgctttcgccacgaaaccttcgttacccagcttgccttcgatgcgcgcaatttcaccttgcgtcttagcaatctctttggccagacgatccagctcagcgtctttatcaatcagaccggccattgggatcatcagctcagatttgccaaccagtgcggttgcacacgccggtgtcgcttcgccatccgccaatacacgaatgctttcgagcttggccagtgaaaccagcactggcttgttcgcttcgatacgcgcggcatcttgctcattcgccgctttcaacatcacttccagaggcttacctgggttgatgtcgtactctgcgcgcaggttacggatgctagtgataaaggctttcacccactcaatatcatccaaggcttcttggttgaagtttgccacatcgtactgaggtagcgcttgcagcatgatggtgtcgccttccacgccatccaccagtggcttaacactttgccagatggtttctgtgatgtaagggatcactggatgtgccaaacgcagggttttctctagtacggtgatcagcgtgcgacgggtcgcgcgttgctgagcttcggtgcctttccaaagaaccggcttagtcagctctaagtaccagtcacagaattggttccagatgaattcgtacagcgtgttggctgccatatccagacggaagttatcaatgtgaccattgaactctttcgcagccagctcgaactgtgattcgatccacttgtcggccagcgagtattcaagctcagcaccggctgcaaaaccgcaatcttgctcttcggtgttcatcagcacgtaacggcttgcgttccacagcttgttacagaagttacggtaaccttctagacgcttcatatcccagttgatgtcacgaccagttgacgccatggccgcgagggtgaaacgtagtgagtcagtaccgtaggcttcgatgccgttttcaaacgtcttatgggtgtttttctcgatcttcgctgccagttgtggctgcatcatgttgccggtgcgcttcgcgaccagagactcaagatcaataccgtcgatcatatcgatagggtcaagtacgttgcctttcgacttcgacattttgtcgccgttttcgtcacggatcagacctgttacgtacacggttttgaacggaacttgcgctttaccatcttcatctttacagaagtgcatggtcatcatgatcatgcgcgccacccagaagaagatgatgtcaaagcctgtaaccagaacatcggttgggtggaagacttttagctctggcgttttttcaggccagccaagtgttccgaaggtccacaatgcagaagagaaccaagtatccagtacgtcatcatcttgacgaagagcaacatcagctgcgatgttgttttctgcacgcacttcttcttcgttacgaccaacaaacacattgccttgctcgtcataccaagccggaatgcgatgaccccaccacagttggcgagagatacaccagtcttgaatatcacgcatccaagagaagtacatgttctcgtactgttttggtacgaattgaatatcgccattttctaccgcttcaaccgctggtttcgccagaatacctgcgcgaacgtaccattggtcagtcagcattggctcaattaccacgccaccacggtcgccgtaaggaaccgttaggtcgtgatctttgatttcttgcagtagacccagttcttcaaattccgccacgatcgctttacgcgcagcaaaacgctccatgccttggtatttagcagggatctctgtgccgtaagcattgcttgcttcgccgtttgagttgaagacttcggctgcatcacggatgttggcatcaaaggtcagaatgttgatcatcggtagctgatgacgtttgccgacttcatagtcgttgaagtcgtgcgcaggggtgattttcacacagcccgtgcctttctccatatcggcgtgctcatcgcccacgattgggatgcgacgaccgacgatcggcagaatgatctctttaccaatcagatctttataacgaggatcttctgggttaaccgcaacacccgtatcgccgagcatggtttctggacgggtggtggcaaccacgatgtaatctttaccatctgccgttttcacgccatcggctagcgggtagcggaagtgccacatgtgacctttggtctctttattttccacttccagatcggagatcgcagtgtgcagttttggatcccagttaactaggcgcttaccgcggtagatcaaatcatctttgtagagacgcacgaacacttcttgcacggctttgtagaagccatcatccatcgtaaagcgctcacgatcccaatcgacagaggcgccaagacgacgtagctgcttagtgatggtaccgccagattctgctttccattcccaaatcttgtcgatgaacgcatcacggccgtaatcatgcttggttttgccttcttctgcagcgatcttacgctcaaccaccatttgagtggcgatacccgcgtggtcagtacccacttgccacaaggtatttttgcccttcatacgctgacagcggatcagagtatccataatggtgtcttggaaggcgtgacccatgtgcaggctgccggtgacgttcggtggcgggatcatgatgctgtacgcgtcttttgatgtgtcaccgtgaggcttaaagtagccttgctcttcccaagtcttatacagatcttgttcgattgatgttgggttgtatgtcttttccatagtgctctttaatggatgctgtgatggttaattcagtctatcgctataagtgagttctcttggataagagagcttaactataaggatggacggttatggatactgaatctcaacagtttgcagctgataacctgcttgtcgatagagtttataccgctcgcgcgccagctgcttggcattttctgcgcagggcacgaagtctaccacctcggtaaaggtacgcgcaaaggttgtctgattatccgccaaatttattgccagttgacgattccaagagggggaaacgcccacataacctatctcaatcgcggtaccggatttgggaccttcaccgaccagattgtgcgctaaaaactgttcgggttcgatttgccaaaatcgctcagctagctgctcggcatgtggtttatcttggcattgcagataaatgcgtgcgccttgcgcggcaaagtgacgcgtcaaatacagcacgtactgcgccaagccttctggcgttgcttgagcagaatctcgggaaatcaggtaaaaagttgcggtaggcatcttggtctcttgcaaacaatcaccacgcctgtggcggtagttgaggtctagtaatgaaaaagggcccgaaggcccttttgcgattactcttcagcgtctaggccaccgctgcgattaagcaggaattggactagtagcgagactggacgaccggttgagcctttcgcggcacccgatttccatgcagtacctgcgatgtctaagtgtgcccagttgtatttcttagcaaatttagacagaaaacaagctgcagtaatggcgccacctgggcggccaccaatgtttgccatatcggcaaatgggctcttgagctgctcatggtattcatcagccagtggcagacgccatgcgcgatcgctcgattgctcagaggcattcaccaactcatgtgccagcgggttgtggttcgacatcaccgcgctgatgtgatggcctaaagcaatcacacacgcaccggttagcgtggcaacatcgactacgcactctggttcaaagcgttcaacgtaagtcagtacgtcacacaaaactaaacggccttcggcatcggtgtttaacacttccacggtttgacctgacatcgtcgtcagaatatcacccggacggtaagcattgctgccaggcatgttttcacagcccgccaaaacaccaatcacattgagtggtaggccgagtttggcaatcgctttcatggtgccgaataccgatgctgcgccacacatgtcgtacttcatctcatccataccttcacccggtttgagtgagataccgcctgaatcgaaagtcagacctttacccactaatacgatgggtttggcttcaggatctggattgcctttgtattcgatgaccgacatcatggattcattgcgtgagccacgaccgaccgcgaggtaagaagccatgccgagcttttccatctcttcttcaccaatgattttggtggtgatgctctcgtaatcgtcagccagacgacgagcttgagaggcgaggtaagccgggttagcgatgttgggcggcatattacctaaatctttacaagcttttacacctgatgaaatagccagaccatgggtaatcgcgcgttcaccaagattcaattcacggcgagtgggcacgttgaataccaatttacgcagtgggcggcggatttctggttttacgctcttgaattgatcaaagatgtacagaccatctttggtggcttcaaccgcttggcgcactttccaataggtatcgcgacctttgacgtgcaactcggtcaagaagcagactgcttccatagagccagtttcatttaaggtattgatggttttctgaatgatctctttgtactgacgttcacccagttcgcgttctttaccgcaaccgacgagcagtactcgctcagacaacacaccgggtacttgatgcagcagtagcatctgccccggtttaccctctagatcaccgcgacgtagcagtgaactaatatagccgtcgctgattttatcaagctgttctgcgactggagaaaggcgacgtggttcaaacaccccaacaacgatacatgcgctgcgctgtttctcagggctgccactcttaacactgaactccatgcgtactcctacatcctgaagacaaatagaactaaatggtagataatgcgctcttacttgctggatcccatctaggatcgaccttttgcatgcgcaacctaaccgttagcgaaattattcaaaaaataaaaggttcatcgggaaattatagtgattcaatcaaaaaaacaagttttgcataggtaatttcagcgtgattattgttagatatttgatccgagaaacaataaaaagccagtttgcgatcttcttcgtgctgtttttagtgtttctcagccagaaatttatccgtgttttggcggatgcctctgacggtgaaattcctaccagcatgatcttatccatcgttggattgaatatgccggcaatgggcttattaatgctgccacttagcctgtacatcggtattctgcttactttcggccgtttgtatgcggagagtgagataaccgttatgaatgcgactgggatcggtaacaagtttttgatccgtgccgccttatatttggctttgattacggcttctgtggctgcttttaatgcgctgtggctcgcgccttggagccaagataaagaagctcatttaatggagcagtttgcggcagaaaacagtgtcgatttgctgcaaaaaggccacttccaacgttcgccagatggctcctctgtggtgttcatcgacaatattgaaaatcgtaagttgtataacgtgtttgtggcgcagttagcaccacgagattcgattttacccagcgtgatgttttctcactcgggcgatgttaaagagctgagtgatggccgtcagattattactctctatgacggcactcgctatgaaggcgtacctacccgagtcgactacatgatcactaacttcgactcttacgacggcttgatcggccaacgtgaagtgaaatcggctgaacgtgattgggaagctctgccaaccttaagcttgcttaataatgcggatcgtcgagcacaagccgaattacaatggcgaatctctctcgtagtgtgtattccactgttgactatgttggtggtccctctttccgcggtgaaccctcgtcaaggacgttttgccaaaatgggacccgctattttgatctatttgacttatttccttgcgctcagtgcgaccaaatcagcgattgaagacggttcactgccggttatcattggcttgtggccaattaatgccgcactgctgttggctgcgctgatggtcaataccttggatagcattcctgtgcgccgttttaaagatcgatggaaacagagaaaggtagcttaagtcgtgtttaaaattcttgattggtatatcggccgcactattgttgctacgacagccttggtactggttacctttgttggcctctctggcatcatcaaatatgttgagcagctccgtaaagtgggtgagggaagctacgatttattgcaagccttgttgtttgtggttctgagtattcctcgtgatgtggaaatgtttttcccgatggcggctctattgggcgcacttatcggtttgggtgcattggcttccagctctgaattggtggtgatgcaggctgctggtttttctaagcttgatattggcctttccgttcttaaaaccgccattccgctgatgattattgtcaccttactcggagagtggggcgcaccacaagcgcaaaaaatggcacgtgatatgcgcgcatttgccacctcgggtggtgcgattatgtcggtgcgtactggggtttgggcacgggatgcgaatgattttatctttatcgccaaagttgaaaacgaacatttgtatggattgaatctgtggcgctttgacgaaaataaaaaactgagtacggtaattttttccgagcaagtcgattacgttgctaacaatgaatggctgatgaaagatgcagtattgacccgtttggtgaatgacatcgagatcagtaaagaatcgttgcctgagtaccgctggcgaacctcccttgctccagacaaacttgccgtagtgacggttaagccggaagagttatctctcactggcttaagtgattacgtgcattacttaaaagcatcagagcaagactcatcgcgttatgagttggctttgtggcgcaaagtgactcagccgatctcgattgcggtgatgatgttgatggcgttgtcgttcatttttggcccactgcgtagcgtcaccatgggggcgcggattttatctggcgtcattgccggatttagtttctacatctcaagtgagttctttggcccactcagtttggtgtatggattaccgccattgtttggtgcgctagcgccaagcttagttttcttagccatcgcgttagggctattgggtagaaagctataacccccaatctcccccaaaaaatcttattttggtcagagtggcaatctcaaaatcaaaagaggaaggtgaataccttcctctttctatattgcttatcgaagcgagttaattggctttcggtaacacaacgacctttgttttagcccagatatcgtgaaagccacgttttttcgtatcaaacaacacagtcaagttggcgagcccaaaccccgatgtggctagacggatcagcgcttgtgtggctgagatgtggtgaccttcctcagtgcaaatgtgcattttccatgcgcgcatacctagcgtttgtccgccgcgagtccagaagtaaacaaagaaatagatccaaaccaaggcaagataaacggtatacactggactccaaatcggatgagaagagagaagatcgctcgcatcttgatacggtgcgtagctcatgagccccgcagccaccaaagcttcaagcactgcgacgactacgccgccagccatcattagaatcgccattacgatcagtgcgtcgtaaatccatgcccctaaacgccgaaaaaaaccagccggaggaagtgtcgcgtagttcatcattatcattcttggttacttgaaagaggccaagcatagccagtgcaaaatccgaaagaaagagagctaacgcacagcttaaggctttgtggtgaaataatcggcaaacgattttattttcaatcttttgctattgcgtgcttcgacttcttacgtataatgcgttccatcaaagggcaacagcctagatgccgatgtggtgaaattggtagacacgacggattcaaaatccgtttccttcgggagtgacggttcaagtccgtccatcggtaccataatttaaagaagccgactcaatgagtcggctttttgctatctgtcatattcatattgatattcgctttcgtgatctaacaaccttcatagcaatcagactgatgcagttattattaacttcttctatcatattcgggttattcactcagatgtaattaagattgtggcaagcattaaaatcacggtagatagattgcaacccgggctctacattcggttgccagtcaaatggaatgagcatcctttcctattcaatagctttaaaatcaaatcacaagagcagatccaactgatcaagcatcttggtattcagcacgtttttctcaatccgggattaagcgatagccagcctttaccgccaagcgttgaagaggcaactccagaagaggctctacctccggttgatagtgaagcggaaaagctatggcaggaaaagcaaacacgaatagagaagctcaacgaatatcgacgtcgagtacaaacttgtgagaaagagtttgaacgttctcttgctcgtatgcgtgcggtagtgaataaaattcgtaaccgccctttagatgccgtcggcgaagccatcatattggtcgatgatatcgtcgacaaattgctgagtgatgataatgtcaccttgcatttaatgaacagcaaaagtgaatttgaagatatctattttcactctttaaacgtgtcagtcattgccatgatgattggtaaagcgagaggcttgcctgcagaaagaatcaaagagttggcttttgcggcgctatttcatgacataggcaaagtgagagtgccaacggcgatcgttcgtaaaaagaccccattaacggaaccggaagaaaactacttacggctgcataccaaatacggcatagagttggccgataatatagaaacgtttcctgaaagtgctaaacgcgtcatcgaacaacatcacgaactgcgagatggttcaggctatccactcggcctaaaaggggatgatattgatgagcttgcgcagattgtggcggtagcgaacgcgttcgacaatctttgccaccccaatattccttcggaacaaaagatcccgtacgttgctttgtctcatctatttaagaattgtaagcatatctataacgcggagaatttaggcatcttagttaagttcatgggggtgttcccaccaggaactgtcgtacagctctctaatgatatggtggggttagtcatttcagtgaatgcaagtagcctcttgtatccgaatgtactgatttatgatccctcagtcccgcgttctcaagcgccgataattgatcttgcagaccgagatctgaaaatcgtcaatgccattttaccgaacaaattacctgataaggttcgtgattatcttaacccgcgttcacggatctcatacttctttgacagcgaagagtaaaagagatccttttagagcattttgagattgaatggcgattaaattgcgtcatttttatgagagaaagagtgataaataaacgtcttgtcggttttgtgttcgaacgagcgtgttttaagaaaaatttgtgattaggggcttgcataaaaaaagcagctccctataatgcgccctcactgacacggcagacgccacaaggtctcaaggctagtcagtgaggcaaaaagcttcggtaaagaaaattgaaaaaagagtttgactctgacaattatctcgctagaatgcacagcctcttcggtaagaaagccgaagcaaaacgctctttaacaatataaaccaatcaatctgtgtgggcactcgttgatgataatcaaaaaagatttatcaatgaactgagtgaccatttgaatgagcaatcattcagcacagtcaattcactatcgaaagatagtatcagtattcattgaggtcgaagcgaaagcttcacaaaacttttaattgaagagtttgatcatggctcagattgaacgctggcggcaggcctaacacatgcaagtcgagcggcagcacagaggaacttgttccttgggtggcgagcggcggacgggtgagtaatgcctgggaattgcccggtagaggggataaccattggaaacgatggctaataccgcataacctcgtaagagcaaagcaggggaccttcgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccacactggaactgagacacggtccagactcctacgggaggcagcagtggaatattgcacaatgggcgcaagcctgatgcagccatgccgcgtgtatgaagaaggccttcgggttgtaaagtactttcagtagggaggaaggtggttaagctaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaatcgcatttgaaactgacaagctagagtactgtagagggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgccctagaggtgtggctttcggagctaacgcgttaagtagaccgcctggggagtacggtcgcaagattaaaactcaaatgaattgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttccnnnnnnnnnnnnnnnnnnnnnnnnnnnnnnnnnnnnnnnnncaaagaagcaggtagtttaaccttcgggaggacgcttgccactttgtggttcatgactggggtgaagtcgtaacaaggtagcgctaggggaacctggcgctggatcacctccttacacgatgattatcgtgatgagtgtccacacagattgattcggtttagatttgagcatcaagtgggtctgtagctcaggtggttagagcgtacgcctgataagcgtaaggtcggtggttcgagtccactcagacccaccactaacgatggggttatagctcagctgggagagcgcctgccttgcacgcaggaggtctgcggttcgatcccgcataactccaccatctttaagcgttttcgctgagaatgtttaaaaatggttttcatcagaaaatcttgctctttaacaatttggaaagctgacaaaacaacaatttattgttgtttgtaaagttctcaatgtttatcgaaagataaacaccaacaacacattcaagtgtgcttggtatcgaataagacttcggtcttgttcaaatttgagtccggcaaaatctgtctcgcactcatgtaaattaaacgcgagacaacttaggttgtttaaacagcaacccgaaactccttcgggttgtatggttaagtgactaagcgtacacggtggatgcctgggcagtcagaggcgatgaaggacgtactaacttgcgataagcgcagataaggcagtaagagccgtttgagtctgcgatttccgaatggggaaacccaactgcataagcagttactgttaactgaatacataggttaacagagcaaaccgggggaactgaaacatctaagtaccccgaggagaagaaatcaaccgagattccggtagtagcggcgagcgaacctggattagcccttaagcactcggtgaagtaggtgaacaagctggaaagcttggcgatacagggtgatagccccgtaaccgacgcttcatcgagcgtgaaatcgagtagggcgggacacgtgatatcctgtctgaatatgggggaccatcctccaaggctaaatactcctgactgaccgatagnnnnnnnnnnnnnnnnnnnnnnnnnnnnnnnnnncctgtgaggggagtgaaatagaacctgaaaccgtgtacgtacaagcagtaggagcaccttcgtggtgtgactgcgtaccttttgtataatgggtcagcgacttatattcagtggcaaggttaaccgtataggggagccgtagcgaaagcgagtcttaactgggcgctcagtctctggatatagacccgaaaccgggtgatctagccatgggcaggttgaaggttgagtaacatcaactggaggaccgaaccgactaatgttgaaaaattagcggatgacttgtggctaggggtgaaaggccaatcaaactcggagatagctggttctccccgaaagctatttaggtagcgcctcggacgaatactactgggggtagagcactgttaaggctagggggtcatcccgacttaccaaccctttgcaaactccgaataccagtaagtactatccgggagacacacggcgggtgctaacgtccgtcgtggagagggaaacaacccagaccgccagctaaggtcccaaagtattgctaagtgggaaacgatgtgggaaggctcagacagctaggatgttggcttagaagcagccatcatttaaagaaagcgtaatagctcactagtcgagtcggcctgcgcggaagatgtaacggggctaagcaatacaccgaagctgcggcaatgtcttttagacattgggtaggggagcgttctgtaagccgttgaaggtgaatcgtaaggtttgctggaggtatcagaagtgcgaatgctgacatgagtaacgacaaagggggtgaaaaacctcctcgccggaagaccaagggttcctgtccaacgttaatcggggcagggtgagtcgacccctaaggtgaggccgaaaggcgtaatcgatgggaaacgggttaatattcccgtacttctgactattgcgatggggggacggagaaggctaggtgggccaggcgacggttgtcctggttcaagtgcgtaggcttgagagttaggtaaatccggctctctctaaggctgagacacgacgtcgagctactacggtagtgaagtcattgatgccatgcttccaggaaaagcctctaagcttcagatagtcaggaatcgtaccccaaaccgacacaggtggtcgggtagagaataccaaggcgcttgagagaactcgggtgaaggaactaggcaaaatggtaccgtaacttcgggagaaggtacgctcttgatggtgaagtccctcgcggatggagctgacgagagtcgcagataccaggtggctgcaactgtttattaaaaacacagcactgtgcaaaatcgcaagatgacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccacgctgtctccacccgagactcagtgaaattgaaatcgctgtgaagatgcagtgtacccgcggctagacggaaagaccccgtgaacctttactacagcttggcactgaacattgaacctacatgtgtaggataggtgggaggctatgaagacgtgacgccagttgcgttggagccgtccttgaaataccacccttgtatgtttgatgttctaacttagacccattatctgggttgaggacagtgcctggtgggtagtttgactggggcggtctcctcccaaagagtaacggaggagcacgaaggtgggctaatcacggttggacatcgtgaggttagtgcaatggcataagcccgcttaactgcgagaatgacggttcgagcaggtgcgaaagcaggtcatagtgatccggtggttctgtatggaagggccatcgctcaacggataaaaggtactccggggataacaggctgataccgcccaagagttcatatcgacggcggtgtttggcacctcgatgtcggctcatcacatcctggggctgaagtcggtcccaagggtatggctgttcgccatttaaagtggtacgcgagctgggtttagaacgtcgtgagacagttcggtccctatctgccgtgggcgttggaagattgaagggggctgctcctagtacgagaggaccggagtggacgaacctctggtgttcgggttgtgtcgccagacgcattgcccggtagctaagttcggaattgataagcgctgaaagcatctaagcgcgaagcgagccctgagatgagtcttccctgacagtttaactgtcctaaagggttgttcgagactagaacgttgataggcagggtgtgtaagcgttgtgaggcgttgagctaacctgtactaattgcccgtgaggcttaaccatacaacacccaaggggttttgtagtggactcaaagctaagcgcataagaatgtgtgtgagaacgaagacagctttccagaattgttggttatcactttttaagaaaaagtgaaatcaaaaacagaatttgcttggcgaccatagcgttttggacccacctgattccatcccgaactcagaagtgaaacgaaacagcgtcgatggtagtgtggggtctccccatgtgagagtagaacatcgccaggctttaatttaagaaacacgttacttataacgtgttttaaatttttgtgtgctgatatggctcagtcggtagagcgcatccttggtaaggatgaggtccccagttcgattctgggtatcagcaccatctatttcgatgcttagctcaaagctgacatcacaaaatttgtttggcgaccatagcactttggacccacctgattccatcccgaactcagaagtgaaacgaagtagcgccgatggtagtgtggggtttccccatgtgagagtaggacatcgccaggcttgatttacgaagccgctgtagatatacagcggctttttgcatttcactttttctagtttatttcttttctttcgtatcgttcagtttccaatcatattggtagtcgatttttcctgaataaagggatagctcaggacgatactgcgcaaggtgaataagaagctcttttttattaccaaaatcaacggcaaaccagtcataaatagaggagaggattaaggtgtcattgttcaatgttgctcccttactgctgttgataaaggtatgtgctgcgttactaagtagtcgttctgtgttttgtgcagtaaaagcttgggattgcagatttgggcagcctaggctggcacaattgaccgcataatgggttcgtggatccttccagatagggcgtaaaattcgatgctcgatgtcattgagggttagggtttgtcctgccacagtaaaaactttctcatcccacggcccaaaactgaataggccccctagtttggttatggacgcgactgggtagttatccaaaattaatttcactgtcagagcgttgtagagattaacccaataagcatattgctcttggcggttaaattctcttggatccaattttgaaagttgatctaagtaatcattgagtagcgttttatcttcctttgttacttctgcataacgaaagagggcgttctctcccacttggacaagattgcgatcgaggatgctttgccaagcttggtgagagacgcttgccgtattactgtcgttgctcgcttgccaataagcccaaagctccgcctttggcgctgcgtatactatgttggaaaaaatcagaataaagaaagcgaagagtgttttcatatcagagtaaccttatcgtgagattgtgattagctagacccgatggcaacgcattttctttcgcgataaaaaaggctgccatttggcagcctagaaatgcttattttaagaagctcggtatcttggcttcatactccgcaatttttgcttcgtgctgtagagtcaggccgatattgtctaagccattaagtagacaatggcgacggaaatcgtcaatctcgaaatggtaggttttaccattcgcggttacgctcagcgcttctaaatcgacggtaatagttgctccttccgtatcatgaacataggtaaagagctcatccacttcttgctcggttaaacgaacgggcaccatctggttgttgatcgagttaccatagaaaatatcggcaaagcttggagcaatcatcactctgatgccgtaatccgctaatgcccaaggggcgtgttcgcgcgaggagccgcaaccaaagttctctcttgcgagcaaaatgctagcgtcttggtagcgaggttggttcatcacaaattctgggttggctttttcacctgcatcgtccaaaaatcgccagtcgtggaacagatgtttgccaaagccagtgcgattcactttttgcaaaaactgctttggaatgatcgcatcggtatcgacgttggcggcatcaagaggaacgactaagccggtgtgttgctgaaatcctgacatggggttctccttgaattaaaactgacgaatatcgacgaagtgaccagcaatcgctgcagcggctgccattgctgggctaactaaatgagtgcgaccatcacgtccctgacgtccctcaaagttgcggtttgaggtagacgcgcagcgttctcctggccctaagcggtcattgttcatggctaaacacattgagcaacccggtaagcgccattcaaatcctgcttcaataaagatcttatctaagccttccgcttcggcttgcgctttcacttgttcggatccgggcacgatcaatgcttggacatgagaggcgacttttttccctttggctaccgctgccgcagcgcgcatatcttcgatgcgcgagttggtgcatgaaccgacgaacactttatcgaccttataatcggagagcattttgccggcttcaagtcccatgtaagccagagctttttctgctgagctgcgttcaacaggatcggcaaactggctaggtgatgggattggctcatcaacggcaatcacttggcctgggttggtaccccaagtcacttgcggtttgatttcactggcttcaagcgtcacgacggcatcgaactgtgcatcctcatcggtttttaatgtttgccaatagtcgacagcagcatcccaatcactgccttgtggggcaaacttgcggcctttgatgtagttgaatgtagttgcatcaggggcaatcaagcctgctttcgcaccaagttcaatcgccatgttacacacggtcatgcgaccttccatggagagatcgcgaatcgcttctccacaaaattccacgacatagcctgtaccgccagcggcagttgttttaccaatgatcgccagtacgatgtctttagcggtgatgccgggagccactttgccccgcacttcgattttcatcgtcttagcgcggccttgctttagggtttgggtagccagtacgtgttctacttctgaggtgcctatcccaaaggcaagcgagccgaatgcaccgtgagttgcggtgtgtgaatcaccacatacaatcgtcatgccggggagggtaataccaagctcaggtcccatcacatgcacaatgccttggtacttgtggttaatgtcgtacagcgtgacgccaaactcttcgcagtttttggaaagcgtttgcatctggatgcgcgccatttcacctgaggcattgatgtctttagtagtggtggagacgttgtgatccatggtcgcaaaagttttgctaacttggcgtaccgggcgacctttttcacgcaagccatcaaaggcttgtggagaggtcacttcatggactagatgacgatcgatgtacagaatcggcgtttcacccggtgcggccaccaccacatgggcatcgtaaattttttcgtaaagagttttggcttttgacattgcttcttccttgagctcagagagctaaagaggagtggggtaaccccactctcaaacttatgaattcaaaatatagcttgcgattttatcgcccattgctgaggtcgatagggctggtttactgcctgcgagatccgccgtcagttcacctgctgctaatgcttggctaaccgcgttttcaatatcacgcgctgccgcttcttcacctaagctgtaacgcagcatgagtgccgcagataagatctgcgcgacagggttggcgatgtttttgcctgcgatatctggcgcgctgccgcccgctggttcgtacaagccaaacttgctctcattcatactggccgaagggagcatgcccatggagcctgtgatcatcgcgcattcatcagaaaggatgtcgccaaaaatgttcgagcagagcatcacatcgaactgtgctggatctttgataagttgcatggtggcattatcgatgtacatgtgtgaaagcgagacatcgggatactctttggcaatttcgctgaccacttcgcgccacagtattgagctttgcagcacgttagctttgtcgatagagcagactttcttacgacgcaagcgagccgactcaaaggcgattcgcgcgatacgttcaatttcaaaacggtggtaaacctcagtatcgaacgctttttcatgagcgccttcaccttcacggcctttgggttgaccaaagtaaatgccgccagtcagctcacgtaccaccacaatatcgaaaccgcgagcagagatatcagcacgtaggggcgaaaaggcttccagaccttggtggatctgcgcggggcgcaaattacaaaacagttggaagtgcttacgcagtggtagcaaagcaccgcgttcaggttgctcgttaggtggcagatgttcccattttggccctccgacggaaccaaacaagaccgcatccgcttcttcacaggcacgcagagtgctttctggcagtgggcaaccatggttatcaatcgcaataccaccaacatcgtgctcttcacgactgaaacgaatgccgtgtttttgctcaatcgcatccaacactttgtgggcttgtgccatcacttccgggccgataccgtcgccgggtaatacggcaattttgtaatctctgtctgtcatgcgagtcctttatgatcgatttttaagttgtgtttgtgtcgcctaaggttcttgaatactgaagctactcagggttagcagtaacttcagtagagctaaggagtatgagcattaaaccgtagcgacgctttttttctgtttaatctgggcgatttgatccgcgcgatgaatgctattgataacatgcaacaaggcttgaccggaagcttcaacgatgtcggttgagacgccggtaccgtgatatttacgtcctttgtagttggcgatgatatccgcttgaccaagaccatcttcaccttcgcctttggcggtgagatcgaatttatcgagtacaatctcataccctgtgatgcgatagatacactgatataacgcatcgactggaccattaccaacagcggcttcgcatttttcttcaccgccacacagcaacttaatactggtggtggccatcacgctacccgattgcacgctcaagtaattgagtttgtagaagtcatcttcttcacgcaaattagagaaatgcatcaaggcctctaaatcgtaatcaaacacttggcctttgcgatctgccagcttcaagaagtcttcatacaaggcatccaaattgtattcattttcgttgtagcccattgaatccatatggcttttcactgcggcacgcccactacgactagtgaggttcagtgcttggtttttgaggcctatcgattcgggggtcatgatttcgtaggtatttttgtttttgagcatgccatcttggtgaatgcccgaagagtggctaaacgcattggctccgacaatcgctttgttgctttgaatcggcatgttgcatagctggctgacaagcttgctggtacggctgatctcgtcgtgtttaatgcctgtggttaccccgagcaactcttgacgggttttgatgatcatcgcgatctcttccaatgcgcagttacccgcacgttcgccaataccgttgatggttccctctacttgacgagctcccgcttgaatagcggcaatcgagttggctaccgacatgcctaagtcgtcatgacaatgcacggagatgatcgctttatcgatattgggcactcggttaaacagcgtttgaataatgccgccaaattcgctcggcactgtgtagccgaccgtatctggaatattgatggtacgcgcaccggcattgatcgcggcttcgaccatacggcacaagttatcgataggtgtgcggccagcatcttcacaagagaactccacatcatccgtatattgacgcgcatgtttcaccgctttgactgccattgcgacgacatcgtcatagctgcggcgcaatttgtcttgtacatggatagtggatgtggagataaaagtgtgaatacgaaaggcttcggcgactttcaaggcttctgccgcggcatcaatgtctttcgcaacggctcgcgaaagggcacaaacacggctatttttgatgtttttagcgatggtttgtaccgattcaaaatcgcccggagaggaaacagggaaacctgcttcgataatatctacccctaagcgctccagtgcgtaggcgatttgcagtttctcttttaccgtcaggctggcagacaaagcctgctctccatcgcgtaatgtggtatcgaatataatcacctgattgttcatgtttgcttcctcgcactgagagttaacggctaacttcctgaatattgttgtaaaaatcggctataaaaaaacccgcatcagctgcgggttttttatcttgtgtggtgtttttcgtccacagcctacccgcgtgatggttccacgatcagtagtaggcctagcaggagagaaaaacgcattgtcatctgtaacaatccacacaattaagttaacagattagtaccgtactcgacacaatgcgtcaacccaaaagttgattttttattcatcttgataagtatttgagcgtaacactgagaaacgagcagttgaaaaggcaggtaatttgaagaaaaagtatccgagtatttataattcatcgaatgatgaataaggaactctgatgacattacgtaaagtcggccgaccaagccaacagactcaagctcgtgaccagttgatcatgcatgcccgtgagcttttctctgtcatgccttatgacaaagtatcgacacgtttgattgcgagcaaagcgggcgtcgatatcagtttaattcgctattattttgcgaataaagctggcttatttgagaccatgttgcgtgaaactttgctaccgatgaaagcgcagctcgggttgttggttgctgagagtagtcaccaaaatctgaccgatttaatgcgtacttattatcgagaaatgttcaaaataccgtatttcccacgtttgattatgcaggtgatgaatacgcctggtagcgatatgaaaaagcagttgattgagaaagtggttctcgatattacgcgtccgattcaggaaactttgtttgagaagctgattgagcgaggcgtgattcgagaaggtatggatccgcaactgtgcaaaatttcttacctaagtttaatgatttttccttttatcgctccgccagccctacttaagattcatggggttgaattatcacaaaccttccttgaaagcttggttgagcacaacattcagctaatggaacaagggtttataacgagaatgggataagctctcaacatagagtgcatacctaggctgaccgctcgcttgtcaccatttcgacaaacaattttcacctgactgtcatttgctgccgataagatcaaagcatcacctcaccagaaggaaggatgtgtgatgagagctatggaaccgatcgctaaactcgatttagctttttcattactctgcttacagcataagtacaatacgcgagtcgcgaggctcagtaagtcaatttctcatacaggagatgggcatctttacgcgctgatgggcattttagcttggtggttagatgagactcatgggctgctgtttctcgcggttggcctgcttgcgtttgctattgaattaccgatttattggttgctgaaaaacagttttcagcgccgacgtccacaagaactttctgccttagtcacggcttatatcacgccgagcgatcgctacagcttaccgtcgggacataccgctgccgccttcgtcatggcgacattaattggttatatctatcctcattggtatgccgtcgcactttgttgggcaggtttaattggcttggcgcgagtgttattaggcgtgcattttctaagtgatgtgatcgctggagctttgcttggcatgggcagcgcaacctatgcaatgagcgtaatggagaaaagcatttgaaaatactgtatggcgttcaaggaaccgggaatgggcatattgcgcgttcaagagccatgtgtgcggcacttaagcagcagcaagttgatgtggattatctgttctcaggacgtcctgttgagaactatttttcaatggaatgctttggtgattttgcgactcgacgagggctgacctttgccaccgaaaatggccacgtcaattacgttaaaacgttacgtaagaataatctgttgcagttttggaatgaggtgaagcgcttagatctttctggttatgacctgattttaaacgattttgagccagtgacggcttgggctgccaaattacaaaatattccctgtattggaattagtcatcagaatgccttcttgtatccagtgccattaaaaggtgcttcttggctggataaagcgatcttgcggcattttgcgccagcccagtaccatttaggtttacattggtaccattttgaacagcctattttgcctcccattatttatgcgccggagcagccgctgagtcagcagaactttatattagtctaccttccatttgaaaatgtgaatgaaatctgtgagttactgtatagatttaccaatattcacttcatttgttatcaccccgaggtgccagaaaacgagttgacggaaaatgtcgaactgcgtcgtttgcatcatggtgattttcagcatcatttacaccaatgcagcggagtgatcaccagtggtggttttgagttgccttcggaagctttagcgttaggcaaaaaattattaatgaagccattggctggccaatttgaacaggtgagtaatgcggtaacccttgaaacacttgggctggcaagtgtgatggagtttcttgaccctgcctgcttacgtctgtggcttgatgagaaacaggctgagcgagtgatctatcccgatgtggctcactttttagttgaatggattctcaaggggaaatgggaaaatagtgaagtactttgtcagcaactttggcaaaaagtcgatttccccagttacgcaattttgggtaatgaactgactaactcaatgagtccttcgttaaaacatttttgacgtgaatattagtgttcagtaaaggatgtatctattgttcaaattaataattaataaaaacccattaaaaatgcatttttatagatttttataaaaattaatcgtattgattattaaggcttttttaaagtaatgactaaaataaactgactttttgtcaatgctattgcatagcttcgaatgattagccgatattactcgccatccaccaaatatctgggcggtaaatattacaaacagcgcttatctttccactggcgatttatgcatatttatcgctagtgacgacactgtgaggcatgcaaatgttagataaaaaagacgcaatgagtgccattgcgagttaccgcatggaaagcaccctccgaggcgtagacctcaatctgttaaccgtttttgatgcagtaatgcaagagcaaaacattacgcgagcggcacacaacttaggtatgtcacagcctgcggtcagtaatgccgtggcgcgtttaaaagtgatgttcaatgatgagttgtttatgcgccaagggcgtggcattcagccaacccagcgtgctcgccaactgtttggcccgatccgtcaagctttgcaattgatccgtaacgagctaccgagttcagttttcacaccggaaacctcaacgcgtctgtttaagctcgcgatctgcagtccttgcgatttacgctttgctcctcagatcatggcatcgattgatgaattagcaccgagtgtacaattgcatttggatgcagagtttgatcgccaaatcgcagagcgcatgcgttatcaagaaattgattttgtgattgattacgctcgatttgatgatcaaggtttttcaagcactgagattttccaagatgagttggtggtggtggcatcaaaacttcaccctcatatccaaggaagtatcacggccgaacaattgagtgcggaaaaacacgcaaaattgtccaaagtgcatgggcagcgtagtttctctgaactggcgtaccgtgattttgattgccagtcttattacgaaggcaccagcctgagcaatgtgttgtatgtggtcggtcagtctgaactggtgaccgttgctccacgttggatggcggaaaatgcggccaatcgtgatgagttgcaaatcctcgctttcccatttgctgagtccaaaatctcgggttatctgagttggcatgagtcgagtgaaaaagacaaaggccatatctggctgcgtgaccaactgatggtgatttgtggcgaagtggtcgcgaatcgctgatcctttgttcattctacgtttctaaagccttgggcagtaaaaactgtccaaggcttttttgttacagaatgagttttaatcgataactttgacgttagtcagttgtgttttggcctttgaaatgtacacttgtgcgctgaaaaaaggcttacaggtgtaagctacaggtaagagatatgacgaacttagatttccacatcgttaaacggatccgccaacgtattgcccaagggggtgataacgccgcgctaaaacataaacaaaacggccaatggcaagcaatcaattggcaccagtttggtgaacaattggatgaactctcgatggcgttgttagctcaaggcatcggtgtacaggacaaaattgcgattttttccaacaacatgccacgttggacgattgctgattttgccgccttacagatccgtgcggtaacggttcctatctatcctaccaatacgccagagcaggcggcttacatcttacagaatgcggatgtgaaagtggtttttgtgggtgagcaggcacaatttgatgctgcactcagccaatttgaacaatgcccagagctgcgtctgattgtggctatgaatgccaatatcgacctcaaacaagccagttgtgcgatgcattgggatgagtttgttgctcaaagtcaccatcaagatcgagcgccgttggatgccttaattgagcaggccaactatgacgatctgtttaccctcatttatacctccggcactaccggaacgccgaaaggggtgatgctggattatcgtaatatcggtgctcagctagagggacacgatcagcgcctgaatctgactcaagaggatgtctcactctgtttcctgccactttctcatgtctttgagcgagcatggacggcgtatgtgctttataaaggtgcgaccaactgttacttgcaggacgtggctcatgtgcgtgaagctttagctgaagtccgtccaaccgtgatgtgtgccgtaccgcgcttttatgaaaagatcttctcagcaatccatgaaaaagtcgttaaagcgccgttggtacgcaaggttctttttacttgggctgtcaatatgggggcgaaaatggcggtgtgccgtcagcagcagcgccaaccttcttggatgcttaaacagagccatcaattcgctgacaagctggtgttaagtaagctgcgcgctttgcttgggggaagaatcaatttcatgccttgtggtggcgctaagttggatgaaaccattggccgctttttccatgcgattggtattaacgtcaagcttggttatggcatgaccgaaaccacggccacggtttcttgttgggatgaccactgttttaacccagattcgattgggctttctatgccgggagctcaagtcaaaattggcgagaacaatgaaattctggttcgtggtcctatggtgatgcgtggctactacaagctcgataaagaaaccaccgaaagttttgatgagcagggttttctgaaaacgggtgatgcgggtcatattgatgaaaatggtaatttatttattaccgatcgcatcaaggaactgatgaaaacctcaggtggtaaatatattgcgccgcaggtgattgaaggggcgattggtaaagatcatttcatagaacagatcgcggtgattgccgatacgcgcaagtttgtctcggctttgattgtgccttgctttgattcattggaagagtatgccaaagaactgaacattaaatatcatgaccgtctggagcttatcaaacatagccaagtactggagatgtttgaaaagcgcgttaatgagttacaaaaagagctggcgaaatttgaacaagtgaagaagtttagattgttgccaaaagcattttcgatggacagtggtgagctgacaccgacccaaaaactgcgtcgtaaagtgattaacgatcgctatcaggatgaaatcgaagaaatgtaccaagattctccgaaaaaatagcgcgatcaagctattatcttgatgttctaaacacctcttggcgaaaatcgctcagaggtgtttttatatctgcaatactatgacccatgcccttgctacctgaggcaacaagcttcgctcatgccaatcacattgtcttttggtgttgatggaagggtgggagccgatactccggtgtgctgacaaaataatctacttttttttaactgctcaatggctgttcaacctaaaagcaaggtaaaggttgaaatggaatgcttaatcaccgtcttattttcgattctgctgtaaaagtgcgcaaattggggttagaccagttgctaagaaagcgttacatttgttgcgtaacctcgcggctgttatgacagacgcaggacatagccgaaagcggagcgttttcgaattaggctacaaataagccctaaactatgtaaaaccaacccttttgccgaccgagcacaaggtatgttggtaaggagacaagatggaaatgctatctggcgcagagatgatcgtccaatctctgatcaatgaaggtgtggagcaaatcttcggatatcccggcggttcagtactcgacatctacgatgcccttcacgaaaaaacagaccaaattaaacacgttctggttcgtcacgaacaagccgcaacacatatggctgatggctatgcgcgcgccactggaaaaccgggcgtagtgctcgtctgctcaggtccgggcgccaccaatacggtgactgggattgcaaccgcctatatggactcgattccgatgattgtgatctccggtaacgtagccactaatcttattggtaacgatgcatttcaagagtgcgatatcgtcggcgtgtctcgtcccatcgttaaacacagctttttggtgaaaaaagccgaagatattcctgaaaccatcaaaaaagcgttttatatcgcgtcaacggggcgtcctggtcctgtagtgattgacgtgccaaaagatgtgatgagcccgcttaataagctgccttatgagtatccagaaaccattaaaatgcgctcttacaacccaacgacggctggccacaaaggacagatcaaaaaagggttacgcgcactgctcgatgcgaaaaagccagtactgtacgtcggtggcggggcgattattgctaatgcagatcagcaaattcgccaacttgcagaggctttaaatctgcccgtggttagtactttgatgggattgggcgtttttcctggcactcataaaaactcactgggtatgcttggcatgcatggtgtgtatgaagccaatatggcgatgcacaatgcagatctgatttttggggtaggtgtgcgctttgatgaccgtacgactaacaacctagagaagtactgccccaacgcgaaaatcatgcatatcgatattgacccgtcatcgatttctaaaaacgtgaaagtcgatctgccgattgttggttctgccgaccaagtattggatggcatgctcaagcttctggaagagagcgctgagcgcaatgatgcggcagcattggatagttggtggaatgagatccaagtgtggcgtgatcgtcagtgtttggcttatgaaacctcagcagaacggattaagcctcagcaagtgattgaaacgctatataaaatcacggaaggtaaagcaattttggcctcggatgtggggcagcaccaaatgtttgcggcactctactatccgtttgataagccgcgtcagtggattaactctggcgggctaggcaccatgggttttggtttacctgcgggaatgggcgtgaaattcgccatgccagaagaagaggtactggtcgtgaccggagatggcagtattcagatgaatattcaagagctatcgaccgcactgcagtacgacattccagtaaaaatcattaacctcaacaaccgtttccttggaatggtgaaacagtggcaggatattatttatcaaggtcgtcactctaactcatacatgagttctgtgccggattttgcggcgatcgcagaagcttatggtcatgttgggatccgtatttctcaccctgatgagctgcaagctgggctggaaaaagcgttagcgatgaaagatcgtctggtgtttgtcgacattaatgtcgatgaaactgagcacgtttacccaatgcagatcaaaggcgaagggatggacaaaatgtggttgagcaaaacggagagaacctaagatgagacacattatttcactgctattggaaaaccaaccgggtgcgctgtctcgtgttgtcgggctcttttcccagcgcgggtacaacattgaaacgctaaacgtatcaccgaccgatgacgaaaccctttcgcggctgaacattacgacgaaaaccgatgaaatgcagctagagcagatccaaaagcagctgcataaattgattgatgttttgaaagtgcaggaagtgacagagtgtgaacacatcgagcgtgagctgatgctggtcaaagtcaaggcctctggttttgcacgtgcggaagtaaaacgtacggcggatattttccgcggccagattgttgatgtcacagcttcacaatacacagtgcaactggccggtacgagcgagaaactggatgcttttattgaggcgattgcggaagtgacggaagttatcgaagtggcacgaagtggtgtggtaggcatcgcgcgtggtgaacgagcgctcagagcttagtttatccccttcctacttgaagctgcagcggtgttggctacgttcgttcaccccaatcacatagtgtatctatgcttatggggatgaactcacttgccgcctacctgcaactccaagtcgtttgggtatagtctttataactacaagcaaagcacaaataaaaaaccagccgaaaggctggttgttatattcaggattcaggattggtgagcgatgtcgcccaccaatcaatcagtgcagaatacgggcgcgaatcgtgccgtcgatcgctttaagcttagttaacgcttcttcagagcgagccgtttccacatcgatgaccacatagccgatttctgcggtggtttgcagatattgagccgcgatgttgatcccttcttcggcgaagatggtgttaatttgggtcaaaatgcccggacggttggcgtgaatatgcagtaagcgagagcagctgcgatgctctggcagtgacacttcagggaagttgacactagagagcgttgagccgttatctgagtatttagccagcttgccagccacttcaatgccaatgttctcttgtgcctcttgggttgacccccccacgtgtggtgtcaaaatcacgttatcaaacttcatcagtggcgattcaaacggctctttgtttgatgccggttcttctgggaatacgtcaatcgctgcccctgcaatatgaccagattcgagcgcattgcacagagccgggatatcgaccacagtaccgcgggcggcgttaatgaagatagcacccggtttcatgcgcgcaaactcttccgcacccatcatatttttagtgccagcggtttccggaacatgcagtgatatgacatcacacttattgagtagctcgcttaaggtatgtacttgggtagcgttaccgagcgagagtttgctttcaatgtcatagaaatatacgtgcatccccaagttttcagcaatgatccccaactgagtaccgatatgaccgtaaccgataatgcctaggcgtttaccccgtgcttcataagagttatctgcactttttttccagatcccacggtgagcaagtgcgtttttctctggaatgccacgcagtaacagtaaaatttcgccgagcaccagttccgccacactgcgagtattggagaatggtgcgttaaacactggaataccgcgtttggcggcggcattaaggtcgacttggttagtaccgatacagaaacagccaatcgccaccagtttctctgccgcattgatcactttctccgtcagattactgcgcgagcggatcccgacaaaatgcacatctttgatagctttaatcagctcagcttcttccagcgagcctttatggtattcgatattgctgtaaccggccgcttgcaaaacttccaccgaagaggggtgaagtccttcaagaaggaggatcttaattctgtctttttccagtgaaactttggccattttatcgtccttaaaactatgggaaggtgggctaacaggcgcttgggttcgaatggttcgaattttggtcgtaatttagaaaagcaaacgttttccttgtgcgccttctgctcactaaattaacaaactttttttgctttgggtaagaaaattacggaataaggcataattttcttagagaaaaggataaaaaacggcacccagcggtgccgtttgtaagcaaataacggaatatggggggaaatgcccgatattactcttcgatttttgcaccttgtggtgtgccagtgatgaccacatcagccccgcgatgagcaaagagacccacggtcacaacccctgcgatgccgttgatcttgctttcgagatctttgggatgggtgatcttcatgttgtagacatccagaataacgttaccgttatcggtgatcacaccttcacgatacacaggatcgccgccgagttttaccagttcgcgcgcgacataagagcgcgccattgggatcacttcaacaggcagagggaagttgcctagaacatcgaccgctttagtgccatcgacaatacacacaaattttttggcaatcgctgcgacgattttttcacgcgtcagtgctgcaccgccacctttgatcatgtcgcgttctgggttgatctcatcagcaccatcgacatagatgtccagctccgatacatcgttacagtcataaacacggatgccgagtgcttccagtttcgcagtcgaagcaattgagctcgaaaccgcgcctttgatttcgtctttgatagtgcctaaagcatcgatgaagtgattaacggttgagcccgtaccaacaccgacaatgctgcctttttctacgtatttcagagcagcccaaccggcggcttttttcatttcatcttgagtcatgcctatctcctgagtatcgatttgcgggtatgttgcgcggcgcgattataaccccaaaccggaagcagaagtaatcacttaggctgagctaaactgagcaattgttcgactaccactgccaaaccttgctgggggtcacgatttttcgtaacggaatatcccagcttgcagtgggcagttgttcgacttgttggcaatcgtgcgcaagaccaatcggcatcgcgccttgctgcgttttaaaccaaggtgcgagagtgcgatcgtaatagccgccacccattcccaaacgctggcctgattgatcaaacgccaccaaaggagtaccgataatatcgagctctcgaaccgggcagatcaaacgttggtcgagtttaggctctgcgatcccatagcgatttttgttcattggtgtgtgtgtgtggtagtgcagaaacagcaagtgaccttttgcgaaagggtgcaaaacagggagatacacttgtttaccttgctgccaaagccattcgatcagtggttgggtattgagctcaccatcattggcaagatacagggcaatacgctgcgcggcagtcacttccggtaagctggcaaaggtatggataagttgttggctagccgtctgttgctcaaacgctgagagtgattgtcgacgctgacgaatttgcaggcgtaggtgtgtacgagaatctgtcatagagagaaccccgggatgccgttgaggatcgtagcccttgaaccatcaggttcaaggcggatcagtaatggtaaccgcaggcttctcggtacaagccgagcttgctcaatagctacccaataccaaccctgttatgttgcttatcggctcagggacataaatccgctgacgaacaccccagggtaaatcaatgctgtgtttattgctttcctggcttcacatttttcaatgcagcttctaatgaagcggcgagctgttccatgcgctcgctaagttgtgactgagtgcccgcattttcttgctgtttcgtttgtaactcgtaacagatattgagtgcggcaatcgtcaacagtttcacctcattggtgactttagttcgctctgccatttctttcaaacgattatcgagatcttgcgcagcttgaagcaaagacgcttcttgacctgctgggcagtttacccgggtcactttgcccaaaatttcaatgtcaaccgcttgattactcatgattaatgaactcttttagcataactaaagatgagtcaactcaggtgaccatcgaggtggaactataggtaaacccaaaacaagattcaagcctttcccgtcgcaacccgagaaatggacgtttgaaaactcacgatttggacaatttgtgcaaaagctaagcaccaactgcaggcgagcgttttcgctctggcaatgaagtggtaggattgggctacctttctcggttagtgaatccaatatgagcaaaaatagacttcctgcttacccagctttagccaatgagctgcgtagcgcttctctcggtattaatcctgccgagctacaagggttactgacggggatgttgtccggcggtttaagcctcaatgataaaagctggcaagccttggttttcgattacaccaacgatggcatgggctggccaattggtgcattagccagcgcagagcagattctgctggcgatgagtgcgcagttggtggataccgattttgagctttcattactcctacctgaaggcgagggcgaggaagccttgtttgagctcgcggatgcggttgcggaatggattaaccactttatttctggattaggtttgagtggcgccaatctgaagcacgcctctgttgaagcgaaagaagcattagaggatctggaagagatgtcgaaattaggcatcgatgaagaggatgacttagccgagcaagcagaattattggaacaagtgatcgaacatatcaaagtctgtgtattggtattacatgcggaatttggtgtcaaaccagagcaagacactaagcccaccgttcactaagtcaacagaaaggaagcgcaatgacggacagccagcagcccaatatcagtaagcctatcagttttgatgtgatcattgcggggggggcaatggcgggggcaacattagcgctcgcgttgcagcacctcagccaaggtaaactgaaggtcgccgtgatagaggcgtttgcgaccgatcattctgcgcatcccggttttgatgcgcgcagcattgcgctctcctacggtacggtacaaatcctgcaggaattacaactttggcctagcctacagccttttgcgactgcgattaaacatatccatgtctcggatcagtctcatgcagggatgacggatattcactgtgagacgcttggggttagcgctctaggttatgtggttgaactggcggatgtggggcgcgtttacgccgagcgcatggctcagtgttctgccatccaacaatttgtgccaagccgagtggtgaatattacccgtgaacaagagtcggtcacggtccaactcaacactaaagagaccttgcaaggtaagctgcttgtggcggcagatggtgcgctgtcgacgtgttgccaagcgctgggccttgcgatgcaggagcacgattttgaacaagtcgcgctgatcgccaatatcaccagcgcgcaacctcatgcagggcgagcttttgagcgttttacaccgcatggccctgttgccttgctaccaatgagccaagatcgcttgtctttagtttggtgtctgccaccagagcaagttgcgcactggctgcattgcagcgaagctgagttcttacaaggcttacaacaagcctttggttggcggcttggcgccttgacccatgcaggtgagagaagtgtttatccactggttttgcgctatcgtgagcaaacggtctctcaccgttttgctattgtgggcaatgcggcgcaaaccttacacccgattgcaggacaaggttttaaccttggtattcgtgatgtggcgactttagccgaagagattacgcgcagcgacgatgcgggtgagtacgcgctactgcagcgttattttcagcgtcgccaagccgatcgcacggcaaccatcagcctgactacaggattagtacacactttctcgaatgactggttagcgatgcgaatggggcgtaaccttggtctaatggcgatggataatttgccgttattgaaagctccgttattgcgccgcactctcggcatagtgaaccgttaataggtaaaagaatgatgcaaagcgttgatgttgtaattatcggtggcggtatggtcggcctagcgttagcggcggctctgaaagagagtgacctacgcattgctgtggttgagaaccaattaccggaagaggcgctaaacccgctgccggatgtgcgcgtttctgccttgagtcgctcaagtgagattgtgctgcgtaatcttaatgcttgggcgggcattgaagcgcgccgcgctgcgccctacatcgcgatggaagtgtgggagcaagatagttttgcgcggattgaatttaaagccaatgagatgacgcagcctaatctgggacacattgttgaaaaccgagtcattcagttggcgctgttcgagcaagttcagcagcaagccaatgtgacactgcatgtgcctgcgacctgtcagagcatcgccgtgggtgaaagcgaagcatggctaaccttgagtaatggccaagccttgagcgcaaaattggtcgtaggggccgatggcgcaaactcttggttgcgtcgacaaatggatattcctttgactcattgggattatggacacagtgctttggtggccaatgtgcgtaccagtgatccgcacaataaagtcgcgcgccagatttttactgcccaaggaccgttagcctttctccccatgtctgagccgcatatgagttcgattgtgtggtcgacagagccttcacgcgctgaagctttgctcaatatgaatgatgtgcagtttaacaaagcgctgaccgcagaattcgatgcacgattaggccgctgtgaagtagtgggcgagcggcaggctttcccacttaagatgcgttatgcccgtgattttgttgcgcctcgggttgctctcgtcggggatgccgcgcacaccattcatccgctggctgggcagggagtgaacttaggtttactggatgctgcctgtttggcacaagagctgctgagcttatggcagcaaaatcgcgacattggtgatgagcgtaatttgcgccattatgagcgctggcggaaagcggaagctgccaaaatgattgcggcgatgcaaggtttccgcgatctgtttgagggggataaccctgctaagaaactgatccgtgggatcggcatgcgtctggttggtcaattgccgggtgccaaagatgaaatcatgaaacgcgcactaggcctgaagggcgatctgcctgagctggcgaagcaggtttggttagagcgtgcctactgattgaataaaaagttcaacaaataaaaagggttggcagtgccaaccatttttacattaaatcgctttatattaaatcgaatgctattgagtgtttgcttgtttatgcataagcgcaacgcagcttcatgatctcttgattgacttcttttacggtctgatagtggcgctgatccgctttctctggcagctttaacttgccattatcgaactcgaatttaccgacgccaaagatataaatcctacctttaaacagacggctcacgtgtttagcaatcatacctggtgtatagcgcttaaacagtctcatacttcgatccttgcgttgttctggcactgcttagtatagaaaaacctaaacaaaaatagtgtgataggtttggtggaataagcagtacttactgattatttggaatatctgtgcagaatgaatcaaaactgcagtcaaatatccagaatcatgtgaccaaatttacaaattcttctgatgttctcagcggtaactgatgaacagcccgtattaagccagcctcttatgacactttaaagaatagtcgtaaaaattctgaacaggcaagttgattgtaaaataattgtaaaaaaatgcccgcatttgggcgggcgaatagtcacagatgcattacacaaaaagtggataactcgaatgctcagttaattcactttctgttgacgagagagtgagcaaacttgggtgctcattgctctcctcaacggtttatagcctagaggattgttctggttttgactatttatgtttttaatttaattttaaattcataaataagtattggtttgtttgaagagactcgcgtgaagatgcaacgaacaatagtgtgttgcagcgaagctgagaagggagcctgatgagggagagtttgagctgccgattcaggcagctcaagtcggttttgatgaatgaccgctattcatcactgagtgaatagggtagtggttggatatgccaacgggtgtctggttgagcagctagacgcagcttgacatcgtgctcaagatcgttgggcaggacgatcaaaccgatcgctattgaatcggtaaaacgataatgagtcagtagtgcgcccgcgctacgccagttttctccgacagcgcgttcaagaaccactggctcatcttggctcagtggcgcactcagattacctttgactatgtacatggcgcgcttattgatgccgcgatacttggcgcgtgccacagtctcttgccctgtgtaacaacctttagtaaaactgataccatcaacggcttgcacattgagtgcttgcggaatgtgttcattttgagccgtttgggtaacgacaggcacggcctcttcaatatccatgcgtgtccatagcgattgctcgacatgcagtccttgccaagcattgacatattgctccgcctgttcggcattcaccaacagcagccagcgctgtggactcatacgcacggctgtaccgcctgcgatacggcgtacatcgccagtcgtttcactcacggtatcaatccaagcgtcggcttgactgcccatcacacctagagcgatatcgctgctttcggcaatcgtcactttagagaagatggcgtatttcttcagctcgcgcagttcgacttccatcgccgattgcggttgaaacattgcgtagccatcgtgatgatgaaacaagcgaaataccgaccataccttacctttggcatcacagtgtgcaccaaaggtgacttgctgctcttgcaaagaaaccacattgcaggtgacttggccttgcagatacgcttttttatcggcaccgaccagcgtgatggctccccatccagtgagatgcgtgagcatcagttcagggagaggatcgtgagaagaaagattgagtactgaaaaacgattttgccagtccatgttgttcaccactgaggaaaaaagtctcgctatgttaatctggatcaacttttttgtcagcttgaacagggactgtgactgagttactagttgtctgtctgcacccttgttacactccgaatcaaacaaaaaccataaggtgaggaatactgatgtacaccgctgaacaaaaagcgcgaatcaaatgggcatgccgtcgtggtatgttggagcttgatgtggtcatcatgccatttttcgaagagtgttttgattcactgaccgagtctgagcaggacgactttgtggctttactggaaagtgacgaccctgatctgtttgcttgggtgatgggacatggccgctgtgagaatttaggccttgctgcgatggtggataagattgtcgctcataacctcagcaaagtccgttaagcttctgtttatcccttccttttacgctcagatgatcgcattgctgattatgctgttgatgctctgggcgttattcgtttcttctattcccttggtgttggtgccctattttgccgcttggatctggcgtggccatctccacagccaatggatgccggcgagtttggtcggcaatgtggaactcacctttgctggcgtattcgagcaagaggggcagcgtgaaatctttcattcggtacatacgctttatgctccgctgtttatctgcttacaagggcagggcaagcgttggtttatctggcgtgatagctgcgatgaagccacctatcggcaattgttagtgcgattaaaacgggagctcaatggctcccgtgatcatgcgcagatctcttgattgctgttgcaagcggagagagcgttatttttccggcacaaggatcgtcgggccactctctgccagttgatctggatagtccaacgtgtagtgtaagccgcgactttctttgcgttgcatcgcgcaacgcaccatcaattcagcgacttgcagtaagttacgcatctcgaggaggttgtttgacacacggaagttgctgtaatactcgtgggtctcctgttgcagtagctgaatgcggcgcattgctcgttccaaacgcttgttggtgcgcacgattcccatgtagtcccacataaagaggcgcagttcgtgccagttatgctgcaaaaccacctcctcatcagaacaggtgacttggctttcatcccaagctgggagtgactctggcatgcttgcgttgggcaactgagcaatgatgtcttgtgacgctgaccatgcgtataccacgcattctagaagagagtttgaggccatacggtttgcgccgtgtaagccggtgtagctcacttcgccaatcgcatacaactgcttaagatccgtttgaccttgcggatttaccatcacgccaccacacgtatagtgcgccgcaggaacgatggggatcggttctttggtcatatcaatgcccaaatccatcaagcgtgaataaatggtggggaagtgtttttcgataaagtcagcaggcttatggctgatgtcgagatacatacagtccgcacctaaacgcttcatttcaaagtcgatcgcgcgtgccacgatatcacgcggagccagctcagctcgttcatcgaaatccggcataaagcggctgccatctgggcggcgcaaataagcgccttcaccacgcagcgcttcggtaagtaggaagttacgtgcttctggatggtataaacaggttggatggaactggttgaactctaggttggccacacggcagcccgcacgccacgccatggcaatgccatcaccagaagaaacatcagggttagaggtgtactgatacaccttagatgccccgccagtcgccaacaccacaaatttggcgcgaatcgtttctacgtgttccgcattacgattccatacataggcgccaacgactttgttggcatcaccgccgattttatcttcagtgatcaaatccagcgcattgtgtctttcaagtaccgtaatgttgggatggttgtgggcgttatcttgcaaggacgtctgcatcgccatccctgtggcatcagcagcatgcaaaatacggcgatggctgtgaccgccttcgcgggtcaagtggtagcgtgggtggtcgttatcgctgtcctcttctttgtcaaaaggtacaccgccatcaatcagccactgcacgcactctttggcatgctcggcaataaagcgcacggtttgttcatcacaaatcccagcacctgcaattaaggtgtcttgcacatgcgattcaatactgtccgattcatcaaagactgctgcaataccgccttgtgcataaaaagtcgcgccttcactgcgcggccctttgcttaatacaatcacttttccgtattgagcgacctgtaaagcaagcgataagcctgctgcgccacttcctatgactaatacatcacattgatgctctcggtctgcattcataaaattgccaattcccaaactgtagcgagtcatccaactcgacatttctttaaattcctcaaagagttgttttctttagaggaaaaaacaccgcatcgattgagcagacatgccacagtgcacaatcaagtggcaagaaattgtcgaaaaattcggatcgttgatacggtgtaagtcctgctattatcatcgcgctaaatgcaatagtttgtaaatcttattgtcatgttagcggttgcactctattaatccgctgcattcaccactatataaagagtgaagcgcacgtgatgtatggggaatacctatctacgcgagaggcaacgggtgaaaatgctgccttgataaggttttgagtaaaatatttcacccaataatgaactttctcgataatgccgagtctctaaaggtgctcatgcaagtagtggtgtcaatattacaattcgcataatgagtacccatatctgagaaggtaggggaataacaataggagtgaccgctcgaatgaacgagcaactgaccgatcaagtgttgattgagcgagttcagaatggggataagcaagcatttaaccttttggttttgagatatcaaaataaagtgtgcaaccttatttcccggtatgtaagcaattcaggtgatgtggctgatgtagcgcaggaagcgtttattaaagcgtatcgagccattccaacctttcgtggcgagagtgcgttttacacttggttgtaccgtattgctgttaataccgcgaaaaatcacattgttgcgcaaagccgacgcccacccgcaagtgatgttgatgctgaagaagctgaattctatgaaggtggtgacgcattaaaagaattatcgaacccggagaacattacgttgtccaaagagttgaagaagactgtgttcgatgcaattgatgcgttaccggatgatttaaaaacggcaatgacgttgcgcgagcttgatggcttgagttacgaggaaattgcggaagtgatggattgccctgttggtacggtgcgttcacgaattttccgcgctcgtgaggcggtagagaagaaaatcaaacctcttctgtaacgcaaattccgtaatgactatggtgaatagaatggctgacaaagaaaaactttcagcactcatggatggcgagatgatcgacaatgagctgattttaggattggctcaggatcaagatgcacgtgatacgtggaaaaactatcatctgatcggtgatgtactccgtggagaggcaccgattcacaaagaatggaatatcgctgaaagtgtcgccttggcgctggaaaatgagcctgcgcacaatccgctacaccactcaacgaacgtgattgacttgcaacaggcaagactggaagcgcagcctaaaccgcaacaggctaaacgtcagttgcctgcttggttgtctcagtttggtcaagtcggtatcgccgcttgtgtctcgttggcggttattttcggcgtacaacagtatggcggacaaagctcaggcgttgaaaatgaactgcctgtgctgcaaaccattcctcttgctggaagcgctgagccagtgagtttgactcgtgattcggtggaaaagcatgcgccagacagcagcatgcaagagcaacgtcgccgcgtaaacgccttgctgcaggactacgaactgcaattacgcctaaacagtgagaatagtgcttctcaccaacacccagttgaatcggttgtggaatgaagaaacttttgatcagtgcgctgacactgttctgtgtaaattcaactaccgcctttgcagaggaagagtctgcagaggcgttgttgtatcagatgaatgaagccagccaacatctcaattacgaactctcatacatcttggttaagaaaaacagcattgagcccttgttgtatcgtcatgcacggcaagatgatcaacaactggcgcatttggtgtatttgagcggccccgtgcgtgaagtgatccgccgtggtgatgaagtgagttacatcgagccgggtgtcgagccttttacgattgaatcgggcaatatggtggctccaaccatccccatgttgaacacggatgtggcggagttgagccgctactatgacttcgtgaaagtcggacgcgcccgtgaagcaggggcggcgtgccaagtactgcgcgtggtcccgaaagatggtttacgttactcgtatgttgtctgggtcgatgaaaaaagtcatttgcctttaagggcggatttgctggatcgcgatggcgaagtgcttgagcagtatcgcaccatttcattttcggtcagcgagcgtttggccgaaatcatggcagggctaaacaaggtgcaactgcctgaagtccttaagttgccaaaaggcagtgtgcaagagaccttctggcaagtcacttgggttccggatggttttcaagccatggagctgaatcgttatcgtatggcaatgacagagcgtttggtggaaagccagatgtattcggacggcctgtttaatttctcagtgtatgtctctgccagtgataactactcactcaaaggtcaattggttcgacaaggccgccgtactttgcacagtgtcgtcaaaggtgagaatgaaatttcggtagtgggcgatattcctcctgcgactgcgcaacgtatcgctcaatcggtgatgtttggtgtcggtggagtgaaagcgcaatgatgacggcattggctacggtgaccaaagtggtacccgctcaacaaggatttcaagtgacgctgagttgtgaacagcaaaccagttgcagcagttgccaatcctcgaaaagctgcggtacgggcatcgtctctaaagcgttcggtaacaaaaccctattctggcgtttacaaaccacacaagccctagaagcgggtgaggtggtcgagattggtttgccggaaaagagcgtgctgcagtcggcggcgctcgtctatttattaccgctgtttttcatgatgctgggtgcatggcttggcgatcaatggctggcccctatgttgggttttggagaggggatagtgatcctcactgcactgctctttattgcgctcggtgtatgggttgccaaacattatgcgaaagtgctggagctacgctctcagcagcaagtggttttgttacgaaaactgggtatcccggttgcctaaattatgatgcgaaccctaacgaaattgggtagaatcgcccaacttgaatgaatagccgccaacgcggcttttctatgtccttattatttaagagtttagtcatcccaaacctatgaagcacattcgtaacttttcgattatcgcccacattgaccatggtaaatcgactctatctgaccgtttaatccaagtctgtggcggcttgagcgatcgtgaaatggccgagcaagttcttgactctatggatctggaacgtgagcgtggcatcaccattaaagcgcagagtgtgactctcgactatacagcgaaagatggccaaacctatcaactgaactttatcgacaccccagggcacgttgacttcgcgtacgaagtatcacgttcattggcggcgtgtgaaggcgcactgttggtggtggatgcggggcaaggcgtagaagcgcaaaccctagcaaactgctataccgcgatcgaaatggatctggaagtcgtgcccattctgaacaagattgacctgccggcggcagagcctgagcgtgtggcggaagagattgaagacatcgtcggtatcgatgcgattgatgctgtgcgttgctcggcgaaaaccggtgtgggcgtggatgaagttctcgagaaaatcgtttctgccatccctgcgccacaaggcgatcctgatgcaccgctacaagcgctgatcatcgactcatggtttgataactacttaggtgtggtttctctggttcgtattaaaaacggtagcctgaagaaaaacgacaagatcaaagtgatgagcactggccaaacttggggtgtggatcgcttaggtattttcacaccaaaacaagtggataccgattcactggacactggcgaagtaggctgggtggtgtgtggtatcaaagacatcatgggcgcaccggtgggggataccctgaccttagcgaagaacggttgtgaaaaagcgctgccgggctttaaaaaggtgaaacctcaagtgtatgcgggcttgttcccagtctcatctgatgactatgacaacttccgtgatgcactgggtaaactgagccttaatgacgcgtcgctgttttatgagccagaaacgtcggcagcgctcggctttggtttccgttgtggcttccttggtatgctgcacatggagatcatccaagagcgtttagagcgcgaatacgatctcgacctcatcaccacggcaccaaccgtagtgtatgaagtgctcaagaccaacaaagagatcgtctacgttgatagcccagctaaactgccagccatcaacgatatcgaagagatccgcgagccgatagcgcgttgtaacattctggttcctgcggattacctaggtaacgtgatcactctgtgtatcgagaaacgaggtactcaggtggacatggtttaccacggtaaccaagtggcgctgacttacgacatcccgatggccgaagtggttctggatttctttgaccgcttgaaatcgacttctcgtggctacgcgtcactggattacggtttccaacgttttgaaatgtcgcacatggtacgtgtggatgtgctgctcaacggcgacaaagtggacgccttggcgatcattacccaccgtgacaactcgcaaacccgcggtcgtcaattggttgagaagatgaaagagttcattcctcgccagatgttcgatatcgcgatccaagcggcaatcggtaaccacatcatcgcgcgctctaccgtgaagcagttacgtaaaaacgtactggcgaaatgttacggtggtgacgtgagccgtaagaagaaactgctgaagaagcagaaagaaggtaagaaacggatgaagcagatcggtaacgttgagctgccacaagaagcgttccttgccattctgcatgtcggcaaagactaatttctttgctggcttcagacttattggtttaacacatgagtgaaagggtttcggctctttcactttcgtattttttagataagggaagtcaatggcgaacacattctcactgattttggtgatcgtaactctggtcaccggtatcgtctggacactggaaaagctggtgtgggcgaaaaaacgccaacagaaacaagctcatttacaggcgcaaacgcccgatatgccagcctcagcgctggataaagtcgtggctcagccgtggtggattgaaaacagtgtctcgattttccctgttattgcttttgtgctggtactgcgctcgttcatttatgaaccgttccaaattccatccggttcgatgatgccgactctgctggtcggggattttattctggttgagaaatacgcttacggcttgaaagatcctgtatggcgcactcagttagtggaaacgggtaaacctgagcgtggtgatattgtggtgttcaaatacccagtgaaccctgagatcgactacatcaaacgtgtggtggggatgcccggagataccgtacgttacagcgcaggtaaagagctgtgtattcagcaccaaggcgagagcgaatgccaagcagttaaactctctaacgtgcaagagagcgagttttaccaaaatgagatccccctgatccagctgaacgaacagctaggtaaggttgagcacaatattttggttaacccattgagcattgataacgtggcgaattatcgcccacgcagtggcgtgaatgaatgggttgtaccacaagggcactattttgtgatgggtgataaccgtgacaacagtgctgacagccgtttctggggctttgtgccagagcagaatctggtcggaaaagctgtggctatctggatcagtttcgagtttgaacgcgctgaagacagcgtacttccacgctggattcctaccggagtacgattcaatcgtgttggtgggatccactaagccagcatgagctggcaataacgttgagattatgacacctccaatgaataaattaacaagtaagctcggttatacctttaaggagactgagctgcttaatctggcgctgacacaccgcagcgccaatggtaagcacaatgaacgtcttgagtttctgggcgattcaattttaagttttgtcattgctgacgagctctatcgccgcttcccgaaagtgaatgagggagatatgagccgcatgcgtgccaccttagtgcgtggtaacacgttggcggagctgggtcgtgaattcgatctgggagattacttaaaattaggtccaggtgagttgaaaagtggtggttttcgccgagactcgattctagcggatgcggtggaagcgatcatcggtgcgatctaccttgacagcgatctggaaacggcgcgcagcattgtgcttgagtggtatcacggtcgtctggaagagattaaaccgggcgcatcacaaaaagacccgaaaactcgcttacaagagtttttgcagggcagaagaaaaccgctgcccgtctacacagtgactaatattaaaggtgaagcacacaaccaagagtttaccgttgcgtgtgaagtggcaggtatggatacgcctgtgatcggtaaaggcaccagccgccgcaaggcagagcaagcggctgcagaaacggctctggagcaattgaccaatggctgatcaagaatttgatatcgatgcatactttgcttctcaaagcgaaggtaaatctgtggtggcatcgacaccggaaaaccaacattgcggttttgtcgcgattgtcggtcgtccaaacgtgggtaaatcgactctgctcaataacctgttagggcaaaaaatctcgattacttcgcgtaaaccacaaaccactcgccaccgcattatgggcgtagagaccgatggcaattatcaggcgatatacgttgataccccagggctgcacattgaagaaaaacgcgcgattaaccgtttgatgaaccgtgcggcgtcaagctcactgagtgatgtcaacttagtgctgtttgtcgttgaaggtactcactggaccgctgatgacgagatggtgttcactaagctgcaaaaagccaacttccctgtggtgctgtgtgtgaacaaggtcgatcaggtcaaagatcgcaacgaagtgatgctgcacatgctggagctttctaaacgcatgcagtttgtcgatatcgtaccgatttccgctaaacagggtaaaaacaccgatgtgctgaaaaagcatgttcgcgaccatttaccgaaagccgtgcaccatttccctgaagagtatgtgacggatcgttcacagcgctttatggcctctgaaatcgtccgtgaaaagttgatgcgttttactggcgaagagctgccgtattcggtgacggtggaaatcgagcgtttcgattacaacccagataccgatggtttccacatcaacgccctgattttggttgagcgtatcggccagaagaaaatggtgattggtaaaaacggcgagaagatcaaaaccatcggccgtgaagcacgtctggatatggaagagctgttcggccgcaaagtctacctagagacttgggtgaaagtgaaatctggttgggcggatgatgagcgcgccctgcgttcactcggctacatcgacgatctctaaacacgagaggtggcaacggggttgccacctttttcatttctaccttcaactgcatgatagaaagggaaaatgtcagacggactgcaacgctgttttgttctgcaccgccgcccttacagtgaatcgagcttaatactcgatgtgttcagtgaggagtacgggcgagtcaccttgatggccaaaggtgcgcgcggaaaacgctccaacctcaaaggtgcgctgcaacctttcactcctttactgctgaagtggtcgggcaatggttcgatgaaaacgctgcgccaagccgaaccaattagtctcggcttaccgctttccggcgtctatctctattctgctatgtacatcaacgagctggtggatcgggtgttaatgccagaagtcgctagccccgggctattccatgattatctgtttgcgctcactgaactggcgcaaagcactaatcccgagccagcactacgtcgctttgaactcgctttgcttgccgcgatgggctacggcgtggattttctgcattgtgctggtacgggcgaaccagtttcaccagacatgacctatcgctatcgtgagcaaaaaggctttattgcctcggtacgccgcgataatctcacctttctcggtaatgagctgattgcgatcagtgaacggcgttttaccagcaaagaacaactgcaagcggcaaaacgctttacacgtttagccttaaagccgtatcttggcggcaaacctttaaagagtcgtgagttgtttcgtcaaacaactctacctagagcacggagtacagaagaatgagctcaatttatcttggtgtgaatatcgatcacgtggcgactttgcgtaacgcacgcggcacacaatatcccgatccagtgcatgcagcggaaattgctgaacgtgcgggcgcggatggcatcaccatccatctgcgtgaagatcgtcgtcacatcacagatcgcgatgtccgtattttgcgtgaaacactgcaaacgcgcatgaaccttgaaatggcagtgacggatgagatggtcgagattgcgctgcaaactcagccagaatacgtctgcttggtgccggaaaaacgtgaagagttgaccactgaaggcggtcttgatgtgctaggtcagttggagcgtgtcaaagcggcaacggaaaaactcactgcggctggcattaaagtttctctgtttatcgatgccgatcgtgagcaaattgatgcggccaaagcctgtggcgcaccttttattgagctgcatactgggcactactccgatgcgaaaagcgatgtcgatcagcaaaatgagctgaagaaaattgcagccgcagcggcttacgcacacgatttaggcattactgtgaatgcgggtcatggcttgacctaccacaatgtcgctgcgattgcggccattcctgaaatttacgagctgaacatcggccatgcgatcattggtcgcgcggtttttgatggtttagcgaaagccgtcgccgatatgaaagccatcatggttgctgcgcgtcgataacgtatgatcgttggactcggaacggatatcgctgaaatcgaacgggttgagaaagcgttggcgcgctcaggagaaaactttgcgcgccgcattcttaccgattctgaactagagcaatttcatgcttcgaagcaacaagggcgctttttagccaagcgctttgccgccaaagaggcggcttcgaaagccttgggaaccggtattgctcagggggtgactttccatgactttaccattagccatgataagttggggaaacctttactgatcttgagcggtcaagcggcagagttagcttcgcagctgcaggttgaaaatattcatctttccatttccgacgaacgccattatgcgatggcgaccgtgatccttgaacgccgttaatgcggcgttcatgctttggttcatttcaaatctttcattttctgactatattttccttacgtgcttaattttccccaacggaagaatgagttttctgactctttgcacccaacgggtatttttgtctcaccaatcactaaaatgaaagatattgggtgatgtcattaatcatcaatgacgatcgaaatggagaatatttcacttggcgtgcaggttggcgctgtggtggaaatcgcgcatgcttagggataacccaatgatacgaagcctttttcaaacacgcctgatgagcggtgttgtcggtctattagccatgacgagcggtgctgccttagcggccgactggagcgtctctggttatggttcgattggttatagctatgaaaatgaagagaatctcggtttcctgcgcaacatcgctcagccagatgattatcaacgcaacggatcgtttaagccagatagcaatattggggttcagtttgatctgcagttagatccgcaatggtcggtgaccactcagtgggtaatgaaagagcgagtcgagcagcgcttcgatgatattactgagctggcttttgtgcgttatacgccggatgaaaattgggatattcgcctagggcgccttgggcttaacgcctatatcgccgctgacagccgacggattgactacgcccacctttggttgcgccctccccaagagttttatggcggcattttctatgatgccatcgatgggattgatgtcacttatcgcagccaatgggatgagatcacttggtcgttaggcgcgcaatatggccgaattaaacagaaactgcaaaataccgcttccagcgaaatttctgccacgcaatccgatcaaacattagctttggtgttttcactcgaacaggatcgttggtttggacgtctctcctatgtgcatgtcgggcaactgaaggtggatctagacggtaattctctactgggtattcaagtcgtcaatcaactggcgcaagccgggcttggcccgatcagcgccgaagcggcgcagctagttgagcaaatcaatcttcaagaagaaaccattgaatattggcaattgggttttggctatcgaggcgagcagtggtcactccaatcagaaatttataccatccttggtgagaaagccgtggttcctgaaggtgtcggtggttacgccattgctgggtacactctcggcaatgtcacaccttatgttatctacggtcggtttaacccgaaaaatgccccctaccaagcacagtctgattggggattatcccctgtcaatggtgcgcaattggcagaggtacagaaatggttgattggtggcattaactccacttacatcgatcagcagacgttttcactcggagtccgctgggacgtcactgctcagatagccttgaaagcacaatatgattacatccagattgccgataatggctatggattatgggccattcctttagaagctgatttgcagggtcgggatgtgcagctgttttctgtcagcgttaactttgtgttttaggaggactcaatgcgatattggttactcctcattcttttgctgagtccatgggtttcggcttccgctgaattgtatgtggttgctagcccgaagagtccgatcatggagattaataaagagcagttatccgctttataccttggacgtaatcgcgtggtgggtaacacttacattaatcaggtgttagatcggagtggtacggtgcgtcagcgcttctttttgcaggtgaccaatatgcaagagagccaaatcaacgcttattgggccaaactgaaattctcagggcggctgcgtgcgccggaatctgtggtgagtgaacaagagctgattgccaaattagaagagaatccgttctcgattggctataccgatcaagtgcccagtgacgcgctgaaagtattactggtgctctatgactgatcaaacgcgaacttcgccactggttaatcgcttgctgaagatgatttcactgtgtgcacttgggtatttgctgatcattttggccatcattattccgcgcggcatacagagtgttgagcagcaaaaacaagagctggaagagaagcttgcgctctccttgagtaactcggcggccattgcactgtatgtgaataattacgatattgcctccgaggtgatggatgcgttgctgcttcatcaagagatcaatgcggttaagttagccagcgtggatggcattgtctttgagcgcaccaccatcccctcaacctacaaagagcagaattattggagtgatgcgaaccgctaccgattagattctcccgtagatggtaatttgattggctatctgatgattcatgaggatcatcaggtgattcgtcagcaagccattaatcagattcttgatcagatagccgtggttttgatccagtttctcgtgacttttattgcgcttatctggatcgttcgccgcttggtcggtaaacccctgacggatctttcacaggcgttatccgaagtgcggccagatcatgatcgcaaagtggcggtagccgcagaagatcaccacaacgagattggtttggtggccaaaagcatcaatgaatttatcgacgcttcccatcaagctttactgcgtgaacgcgagctgcgtcaacagattgaacgttgggaaagctactatcgcaccattgccgaacaagacacgctgacgggactaaaaaaccgtttaggttgtgagaagttcgtgctccgcaaacagcgtgctagcaccactatggtgctgctattgattgatttggatggttttaagcaggtgaatgataccttggggcatgcggctggcgatgaggtattacgtgaaatcgccaaacgtttttatgccttggcgcaaacacatttttctgattttgtggtcggacggctcggtggtgatgagtttgctatttacattccgctggatgaatttgttgccgaatctatcgagcggtttgcggctcagttgatcgaatcctcctctgagccgattggattgggtcagcagagtgcgcaagtgggttgcagtatcgggattagtcatatgaacagtctgcacattgacttagaaaaactgctgctacaagccgataaagccatgtactgggtcaaatacagaggcaaacatggctatcatatttatcgaatgggggaagagatcctgcctcttcccagtgcgaaagaactcaagcaggatcagttcagatagtcgcgagaggcttcgagcactttcgccatctcatcttgcaactcaaataactcaggctctaactcatcgatgctcgccccattgcgcagcgcttgctccaaactggcgcagatttttcgcaggcgcggtacgccgctgtacgaacaactgccatgcaacttatggatatgatgcagcagatcgctagcggggtattcttcatcctcaagcgcagtattgaccacagtttcgacttcccgcaaataatcgaccaacatcccgagcatctctttggcgagatcctctttattggcggattggcgcagcgcgacaggccaatcaataatggcctcttctgctggcggtgatgagggtaaggcgttagatatgaccgcagcaccatcgggtggggtcactttcgcgacctgtttactgcgcgtgtgcgggctccaatgtaccaacacttgttgcagaatatgctcttcaatcggtttggtcaggtaatcatccatccccgctttcagtagacggtcacgctcgcctgccatggcatgtgcggtgaccgcaatgactggcgtatcacgataccctttgagctgcttgatcgctttacaagcggtcactccatccatgtgcggcatttgaatgtccatcaagatgatatcgaactgacggctctgagcttgctcaatcgcctcctgaccgctggtgcaagagaccacgtactcaacccgctcttgcaatagcgcagtgatgagtttgaggttggctggattatcatcgaccgccatgacgcacagcggaagcttatcggcttgaggtttgggcaaactggtattggcgagttgcggctgttgcgctgccaaggtttgtagcagttttttgcgagataaaggcttactgatgcattttactgggtagcgctgcatcaattggtcggcgagcgccagttctgtgctcggcacaccgacaatcacattgtgggtcatggctaacgcgcgttgcacccaaagctccaccaaggtcggattggtctctttactaggcgctaagttgagcagtacatagtcgtaaacgtgttgctcttccggaatcgcagagcggtacgtcacttctaaaccactttggaccagcgtttgctgcacaatcgcagcggcttgcatattgggttcaatcagcagcaagtggcgatgattgagcgagtccgcgttataaccgtcattgagaggcagctctgtggtatgcaggcgcagcgtgaaccagaaggttgaaccttggtgcaaacggctggtgaggctgatttctccgcccatatggctgaccagtttttgggtaatcaccaacccaagtcctgtaccgccataacggcgtgaaatactggcatccgcttggctaaaggcttggaataactgagcttgctggcgctcagaaatgccaattccggtgtcgcgcaccataaattgcaggtcgatcacatcatcgcgtagcgcacgcatttccacgctcacgtctatattgccacgctcggtaaacttaatggagttaccgaccaagttggtcaagacttgctgaatccgtagcggatcgcccaccacgccgcgcggaattttcgggtcaatcttgagggtgatttctaaccctttttcatgcgcgctggtggcttgcagattaaccacctcttccaatacttcttggaattcaaacggaatattctccaaagccagcttaccggcttcgagtttggaaaaatctaaaatgtcattgatgatggtgagaaggttattggctgatttttcaatggtttgtagataatctgcttggctgttggtcaactgggttttcagcatttgccgcgtaaaaccaatcacaccattgagtggggtgcgcagctcatgggacatgttagccagaaattcggattttactcgtgccgcttcttgagcgcgctttttggcaatatcgagttcaacgttttgaatctcaagctgttcaagggtttcccggagatcggacgtcgcttggtcgatactgtgctgcatttcgacatggtattcggagagcgataccgccatcgcgttgatgccttttttcagcgtatccaactcgccgtgcattttaccttcaatccgcacatccaaatggccgcgacgaatgcggtcgaccatatttttcatgtgagtgattgggcgagtcacatcgtacatcaagcgcgaagcaaatacccctgacagcaaaatcccgatcactagcactaaaccagcggaaaaaatttcctgatactgttgtaaacgcagtgaggagagatccagttctatcgcaatataacccatcaccggtgtggcgggattagcatcgccattgtcgagcacggtgcgttcagaaatgatcggcgttcgtaatatcagcgtgttctcgtcaatcacggaactactcagaaacgggatcggcttatccttgggatacatcagcttttcgaaattggggtggaagttcgaggtgacaaacagctcatgattggcatcaaacaccgcgatgctgcgtactaacttagaatttttacggtgggcatagctgataatgcgtcgcaccgattctcggctctgcatacgcagcgcatcttcactggcgatcgctaatggctcaatgatgctggcaccggaattgatcacttgagtttctaaatcgtgataacggttaaaagagaacagagcgctaagcagcagaccaataatcagggtaggtgccaaagtgagcgtcataacgcgggcgcgcaagccatatctttgagtcattattgtctaaacattgtggtgtggatatgggaaaataccccgcacaaatcggattgcgtggggaaacgttggcgttagcttaatcaactccctcatcttcgacaatctcccccgtgcagaatagtgatgccggggcgaaaacaaatctatttcaacacttgagcacagagcatggcacgtttctttcaaccgaaaaagcacagcacgttagacacaaagcatcagccggtcactattgaacggttggatcaccaaggcagcggactggcctttttacacaagaaacccttgtttgttgacggcgctttgccgggggaagaggtgctgattcagctcactgaaaacaagagcaaatacgcgcgcggtcaactgattaaagtgttgaaacccagcgctgagcgtgttgcacctttttgtgcgcattatgcgcaatgtggtggttgcgatttacagcatcttgaccgagcgggacaaatccatcacaagcagcaagccttaagtcaattaatggtgaagtttgcagggcagagtcttgctctgtctgcgccagtttgttctgatgatcaaggctaccgtcgtcgcgcacgcttaagcctgatgtgggataagaaaactcagcaactacaattgggttttcgccgcaagcagagcaaagcgatagttaatgtgacccattgccccgtgctggagccgagtttaaatgcgctattgcctgatttgaacgctttgttgagtgagtggagtcaacctgagcggttggggcatgtcgaattggtgaaaggggataacactcgcgtgttggtgctgcgccatttaggcgcgctgattgaacaagatcagcagcgtttgactgactttgcttcgcaaaaccaactaaccttatatctgatgctggaagcaggcgagttgcaacatgtgcaaggtgaagcgccatactgtgaagaaacaggcagccgcttaagtttcttgcccagccattttattcaggtcaatcgcgcggtgaatcagcacatggtcgtgcaggccttgaattggcttgaggttagcccacaagaacgcgtgctcgatctcttctgtggcttaggaaatttcacgctgccgctggccaaacaagcgcaagcggtggtgggtgttgaaggtgttgatgagatggtgcaacacgccactcataacgcgaaattgaaccaaatcaataatgtggcgttttatcaggccaatttggaacaagatatgacgagcgcctcatgggcgcagcagaaatttgctaaagtactgctcgacccagcccgcgcaggcgcagaagggattgtggatcaactctctgcgttaggtgccaagcgggttgtgtacgtgtcgtgtaaccctgcgacattagcacgagacagtcaaagcttgctgagccaaggatttcgcttagagaaactggggatgctcgatatgttcccgcacaccagtcatctcgagtccatggctttgtttgtgaaaaagggctagcgattgaactcctgatacgagcgtcagtcgaaggctaaaaatacaattattaggacgatatcaatggttgcggtacgaagcgcacacttaaacccagaccaacagtttgagctagaaacatggatagccagcctgacccaagaggggaaaacggccgctaaattaaccgcagtgtatcgcgattgcgagcaactgttggcgggcaatccacaagggcctctgctgctttggcgtgggcgggaaatgatcgaaattttgatcaccctatcgatggaccgcccaacgttggtggcggctttgctatttccgatcgccaccagtggtgtgctggataatgagtcgcttgaagagggatatggccgcgaagtggttaagcttatccacggcgtggaagagatggcggcgattggccagctcaacgtcaccatgcatggcagtgaagcgtcagcgcaagtggataacgtgcgccgtatgctactggcgatggtggatgatttccgctgcgtggtgattaagcttgccgagcggatctgcaacctgcgtgaagtgaaaaacgagccagatgaagtgcgccgcgtagctgccaaagagtgtgccaacatctatgcgccactggctaaccgccttggcattggtcagctcaaatgggaaattgaagactacgcgtttcgttaccaacaaccggatacctataaacagatcgccaaacagctttctgagcgccgcatcgtgcgtgagcagtacattcgtgattttgtcagcgacctgcgtgctgagatgaagcaatccgggattaacgctgaagtcagcggtcgcccgaaacacatctacagcatctggcgcaaaatgcagaaaaagagcctcgcttttgatgagctgtttgatgtgcgtgcggtgcggattattgctgataagctgcaagactgttacgccgcgcttggcattgtgcatacaaaatacaagcacttaccgaacgagtttgatgactatgtagcaaacccaaaaccgaacggttaccagtccattcataccgtgattttggggccggaaggcaaaaccatcgagatccagatccgaaccaagcagatgcatgaagagtcagagcttggggtagcggcacactggaaatacaaagagggcagcagtgcagcacgcagtggctacgatgagaagatcacttggctgcgtaaactgctcgattggcaagaagagatgtccgattcgggcgagatgctcgacgaactgcgcagccaagtgtttgatgatcgcgtctacgcctttaccccgaaaggcgatgtggtcgacttacctatgggcgcgaccccgctcgattttgcctaccacattcactccgaagtggggcatcgctgtattggcgcgaaagtggcagggcgtatcgtgcctttcacccacaaattgcagatgggcgatcaggttgaaatcatcaccgccaaagagccgaatccatcacgcgattggttgaacccatcgcttggtttcgttcattcagggcgtgcgcgcgccaagattaatgcttggttccgcaaacagagccgtgaaaaaaatctcgaagcgggacgggaaattctcgaaatcgaactggcgaaaatcggtgccaatctcaagcacgccgaggcgtatgcgctcaagcgctttaacgtcaatagcgtggatgaaatgtacgttggtatcggcagtggcgatctgcgtatcaatcagatcgtgaaccatatcaatgcgttagtgaataaaccgaccgctgaggaagaagataagctcgcgctggaaaaactgcaggaaaacaaaaccctaacaccgaatcgcccgcataaagatgcggtggtggtggaaggggtcgataacctgatgacccaccttgcgcgttgctgtcagccaatcccaggcgatgaaatccgtggctacattacccaaggccgtggtatttcggtgcaccgcagcgactgcgagcagctcgaggagcttagccttcatgcaccagagcggatcattgataccgtatggggcagtggttttgtaggctcttatctactgaccgtacgtgttgaagcgatggagcgcagtggcttactgaaagacatcacgactttgctggccaatgagaaagtcaaagtggcgagtatgaagagccgctccgactataaacgccaaatcatcatcatggatttcgatcttgaggtgaacaacgtcgaagctttagcgcgcgtttctaaacgcatcgagcagatcaaagatgttatgttggtcaaacgcttaggttaaatccaacgcaaacagcgaggtgtgaagtgaaaacttccacctcgttgctttttcaacgtcaatacgtttaggcgctcaatgcctgatgtgaggaaagccatgtcacacccgattgaacaactcgaacagatcatgcgccgcttgcgtgacccagaacaaggttgcccgtgggataaagagcaaaccttcgacaccattgcaccttacaccatcgaagaaacctttgaagtggtggatgccatcacccagcgcgattggcctaacctgcgtgaagagttgggggatttgctgtttcaggtgattttctacagccaaatggccaaagaacaaggcctgtttgagtttcgtgatgtggtggaaacggtcaacgagaaactgacccgccgccatcctcatgtgtttggggatgccacctttgaaaatgacgcgcaaattcacgccaattgggaagcggaaaaagccaaagaaaaagcgcaagcaggcaaaagtgagcaaagtattctagactctgtaccacgttcgttgcccgctttatcgcgtgcctacaagatccagaaaaagtgtgctcaatacggatttgattgggatagccttggccctgtggttgaaaaagtgcacgaagaagtcgaagaggtgatggaagaagcgctgcaagtggatgtggatacgcaaaaagttgaggaagagctaggcgatcttttattcgcaaccgtcaatttagtgcgtcatttaggtcatgatcctgaaatggcgctgagtaaagccaacgccaaatttgtgcgccgttttcaaggtgttgaggacaaagccagagcgaaaaataagccgctgcacgcgttcactttggctgaactcgacggattttgggatgaagtaaaacttgaagaaaaacaggcaataaagtcattttcctgacggagtgtgaaaaataacaatcaatctacagtcaagtttaatggttgattaagcagcaaatttgtcttgtgcgaaaaaagagcgcgctttgagacaaaagtgactcagataatgtgcccaacacagtgtttgcttcaatttggtttgatttgaagcaaaaaataaaaaattgagtgtgatagatttcacgttgtggcaatgggggccttctggtatagtttcgtcccgtccagaagaaatccatttccctcattcaaccaatttcaggttaaacatgacgacaaattatatttttgttactggcggggttgtatcctctctaggtaaaggtattgcagcagcatcccttgcagcgattcttgaagctcgtggtcttaaagtgaccatgatgaagcttgacccttacatcaacgttgatccgggcaccatgagcccaactcaacacggtgaagtgttcgttacggaagatggcgcagaaaccgacctagaccttggtcactacgagcgtttcattcgtaccaagatgaccaagcgcaacaactttaccgcaggtcgtgtttacgctgatgttctgcgcaaagagcgccgtggcgactacttaggtgccacgattcaggttattcctcatatcactaacgcgatcaaagatcgtgtgattgcgggctcagaaggccacgacatcgctatcgttgaagttggcggtactgtcggtgatatcgaatcactgccatttatggaagcgatccgtcagctcgcgatcgaagtgggccgtgagcacgctatgttcatgcatctgacgctggttccttacctagcggcagcgggcgaagtgaaaacaaagccaactcaacattcggtaaaagagctgctttctatcggtattcagccagacattctggtttgccgtagcgatcgtatgatcccagccaacgagcgtaagaaaattgctctgttctgtaacgtgcctgaaaaagccgttatctcaatgaaagacgtggattctatctacaagatcccacaactgatccgctctcaagggttggatgatttggtgtgtgcacgttttggcattaacgcgccagaagcggatctctctgaatgggaacaggtgatttacgaagaagcgaacccaaccggtgaagtgactatcggtatggttggtaagtacaccgaactgccagatgcttacaaatcggtcaacgaagccctgaaacacgccggtctgaagaaccgtctgagcgtgaccatcaaatacgtagattcacaagacgttgaaaccaaaggcaccgatgtgctcaatggtctggatgcgattttggtaccgggtggttttggcgatcgtggtatcgaaggcaaaatccgtgcagcgcaatatgcacgtgaaaacaaaattccttaccttggcatctgcttgggtatgcaagtggcactcattgaatacgcgcgcaatgtagcgggtatggaaggtgcacactcaaccgaattcaataaaaacaccaaataccctgtggttggtttgatcacggaatgggtagatggcgaaggcaatgtcgaagagcgtagcgagaaatcagatctgggcggtaccatgcgtctaggttcacagctatgccaccttgagaaaggcactaaagcgtacgagttgtacggtagcgcaaccattcatgagcgtcaccgccaccgttacgaagtcaacaacctgctgcgtcctcagattgaaaaagcaggtttgaaggtttctggtctgtcagcagataagaagctggttgaagtgattgagaaccctgctcacccatggtttgtggcagcgcagttccacccagagttcacctcaaccccacgcgatggtcaccctctgtttgctggctttgtaaaagcagcgggtcagttccaacgcggtgaattgaagtaaaaggatacgggtagccactttagcagtgtggctacccttttagttttgacatttaaattcaattgagaggaaacattaatgtctaagatcgttaaagttctaggtcgtgaaatcatcgactcacgtggtaacccaacggtagaagcagaagttcatctagaaggtggtttcgttggtatggcagcagctccatctggtgcttctactggttctcgtgaagcgcttgaactgcgtgacggtgacaagtctcgtttcctaggtaaaggcgttctgaaagcgctggctgcggttaatggtccaattgcagacgctctggttggcaaagatgcaaaagatcaagcaactattgaccaaatcatgatcgacctagacggtactgagaacaagtcaaacttcggtgcaaacgcgattctagcggtttctctagcaaacgcgaaagcagcagcggcagcaaaaggcatgcctctgtacgagcacatcgctgagctgaacggcactcctggcgtattctcaatgcctctaccaatgatgaacatcatcaacggtggtgagcacgctgacaacaacgtagacatccaagagttcatgatccaacctgttggcgcaaaaactctgaaagaagcagtacgtatgggcgcagaagtgttccataacctagctaaagtactgaagtctaaaggctacaacactgcagtgggtgacgaaggtggtttcgctcctaacctgaaatctaacgcagaagcgctagaagttatcgctgaagcggttgcggctgcaggttacaaactgggtactgacatcacactagcgatggactgtgctgcttctgagttctacgacgcagagaagaaagaatacaacctgaaaggcgaaggtcgtatcttcacttctaacggtttctctgatttcctagaagagctgactgagaagttcccaatcgtttctatcgaagacggtctggacgagtctgactgggaaggtttcgcataccaaactgagaaactgggtaagaaaatccaaatcgttggtgacgatctgttcgtaacaaacaccaagatcctgaagcgtggtatcgacaacggtatcgctaactctatcctgatcaagttcaaccaaatcggttctctgactgaaactctggctgcgatcaagatggcaaaagatgctggctacactgcagttatctctcaccgttcaggcgaaactgaagatgcaactatcgctgacctagcggtaggtactgctgcaggtcaaatcaagacgggttctatgagccgttctgaccgtgttgctaagtacaaccaactgatccgtatcgaagaagcactgggttcacgtgctcctttcaacggtctgaaagaagtgaaaggccaagcttaattttaagcgagcgccttcgcgactgttgacgataacagtctcgcgataaaaaacgccctgcattgcagggcgttttgctttctacggttgcaggcaacgaactacagagcctcgattgccgatacgcgccgtttatccaactcttctttgatatgcttgccttgaaaaccatccgctatcacggcttgaactgctacgccaagggcggcttggtaggcacgcaggaaaatctcacgctgcggatacggctcactctctaaacctaaacggccacgatgatctgcttcacaacacagtagcacttgctcaagacgctccggtttgcgccacacatccaaaagccccagcactttcagcttggtggtaggctttaactcgtccgcacgatggatattggaatgctgcgcgcacaccgcgagcgctaaatcgcgaaactcattaggcacgcgaatgcgctcgcacaatgattcaatgatgttaagcccggtatggcagtgcaatttatgtctgggccattcagaaggtggggtcacgccttttcctaaatcatgcacttgcgcggcaaaacgcacgagaagggagtcagaaagttgtgcggcttgcttggcgaccattaacgtgtgaatgccggtgtcgatctctgggtgccatttttccggttgtggcacgccaaacaagcgatcgatttcaggcagcaccaccgccaatgcgccgcaatcacgtaacacctgcaaaaacatttcgggatgatgggccgagagcgacttatgccactcttgccacacacgctcggcggttaagtgctgcaactcgcccgattgcgcaatcttcgccattaactgcatcgtctcttcggcaacggtgaaacctaggtgatgcaacttggccgcaaagcgcgccacgcgcagcacacgcaagggatcttcgacaaacgcgggcgaaacatggcgcagcactttcgcggcgagatcgcgctgaccgccataaggatcaatcagttgcccagagttatcttgcgccatcgcattgatggtcagatcgcggcgcagcagatcttcttcgagggtgacatcgggtgcgtagtggcaagcaaagccggtgtaacctacgctggttttgcgttcggtacgggcaagggcatgttcttctttactgttcggatgcaaaaacaccggaaaatctttcccgacggcttgaaagcctgccgctaacatagcttgtgggctactgccgaccactacccaatcacggtcgtaaaccggaagttgcagcaattgatcgcgcactgcgccgccaacgaggtaaatttgcatcgtagagtctcaaaaaattgcatgaatgacattggctaatcttagtcagcaatgatacgttgcacccactgcgatgaatagggtcaacaagcatgtatctgaacttctttgggtttgacgaattaccgttttctatcgtccccaatgcgcgttatctctacctgagtcagcgtcatcaggaagccatagtacacctgcaagccggattgggcgatggcggcggctttgccatgctcaccggagaagtcgggacgggaaaaaccactgtcgcgcgagcgattctggcgagtttgccaggcaaaacgcgcgcggggatgatcctcaatcccactttctcggatctggagctattggaagcgatttgtgatgaatttgaggtcagctatccgaaaaaagcgaccttaaagaaacttacgcaagtactgcatgagtttttgttggccgagcacgcgcaaggcatacaagtgcttttgatgattgatgaagcgcagcacttggcaccggatgtgttggagcagctacgcctgctgaccaatttggaaaccgagagccataaactgcttaaagtactgctgattggccagcccgagttgcaagaaaaactgcgtttgccgcagttgcgccagctcgcccagcggatcactgggcgctaccatttactgccattgaatgaagagcaaacggccgactacatccgctttcggattgagcaagccagcggtaaccctgagctgtttaatcgtaaagcctgtcagtggattgcagagcaaactcacggtattccgcgcttaatcaatctggtgtgtgatgcggcgttaaagcaagcgtatcaagcgggtgaaccaacgctgagcctagcgagaattaagctcgcctgccaagaggtgatgagctttcaatcttctgtttatcaagtagcctcggccaaacctcctgtccctaagctctcttatctctccagcgcattgggggggatagctctggccgtcgtactggcatggcaattaccgcctcagcttgatcgggttatgcaacactattttccgttacctgaagtggtgccgccgaccgaacagagagttttcccgcaagcgttacgtagtgcgttactcaacgcgacgagcagcgagcatgcccttgaaactctgtatgcggtctggggctatcaagcctcggtgctggagcagttttgtcagactcaagcagatgcggtgctttggtgtgaagagcagacgggcgattggtcaacgctgcaaacttacgatttgcccgctgtactcactttaatgatggatgatgtgcccacttacgcggtgctgtatcgcttaacgggcgatcaagcggagctgttggtgggaggcgaacgttatcgtattgcccgccaatggctagagccgttatggaatgggcaattttcgctactttggcaggccagtttttctcgaacattaaagcagggaatgcagggagccgatgtagccttgctcgagagcaaattggcgcaagtgttgggcgaacctgaacgcccgcgtgagcaatttgataaggatttgtcgcgtaaagtcgagttattccaacgttggcaaaatatgcatgttgatggtatcgcaggaagacaaaccttacgccgccttgagctattgacccagcagcaagcgccgagtttgaaggaggaaggctaatgtcaaaagtgatgaatgccttgaagcagtctcaacaaaagtatctgcaagctcagcctgtcagtcgtcgcacttataccgagcaagaacccacagcgatgaatccgtcacgctggttgcatttagcgctgtggctcgttccggggttagtgacagcgggagtgatgacttaccaacgctatgaactagtgcagcaggaagtggctaatcgacaaaccgagccgacaacggtgcaagttgatgcgccattagagcgtttagcgtatcccgaatttcaggatctgcaacctacctttgtcgaatcaggactcgatgaaccctatccagaagaggatgtgactgcgctagccgacaacattgtggctccaccggcgacaatccaagcttctggtcagcagagcgcgtcaaataaggcgttgggcgatctcgatttaactcagctttcgcctgaattagcgttacgcgtgcaggcgattatgcgcgatcaatccagtgaaccagccaccccaagcacaccaacctctgcggcggtgtcattaactcagcacagtgatcgttatcaagggcagcttcccgcactgaattttcagatgcacgctttttccagtaatgaacaaaaacgctggataaaagtgaatggagtagagtaccgcgaaggagatatgctgacaccagaagtgaagctagagagtatcaaaccacaaagcagtgtgattatctttggcggagaggaaattgagatccccgcactgtatgattggaaaggttagggcattgaccaacgcttattgcccgacgatgaaagagagcgaaaacaaaacggtcacttgcgtgaccgttttgctatgcgatgaattccgcttatgcccatccggcagggtggcgtttacggcgaggaataatatgtggtaacaccaagccaagcagtaaaccgataccagcaacaccaccaccgtaggtgaagtatttcagtaacagatcttctttttgcgtatcgagcttggcgcgcagttcacgaatttcgctttgtgaatcggtcaactgcttgctgatgtcggcatagttacgctctagatcggcaatttgttggttacgcagttcaagtgattccgctaatcctgctttttcactatcggcattttggcgagcattggctaacagctttttcacttcctctagctctttttctagcgccggtaagcgcagagtattgctcacttcacgagtgataaaacggctttcaacccaacctgtacggccgcgctcatcagcaatatggctataaccactctctttgttcacctcaatcagcttcaccttttctccggcgtcaatgctgccgagaatacggtattggttacttgggcctgaatgcatgtaagtaaagagtttgtccgcgatgtagcggtcttgcgcgaacgttggtgcagccaacatggaaaagagcaccatgcagatcagttttttcacagtaaatcccttattttaaagatagatttggcgataagtctcataaagtttgtggcaaatagtatgcagttttagcaagcgctgcaacaaagaagggaggctaagcctccctttctgtgcgtttgagtcaataatgacagttcgctaacactgagcttactgcggcttagccgacaaacactgcttgaatcgcgtagaagaaaaccacggctaagagtgcgcctgccggtagagtgacgacccaagaggcaacgatgttacgtaccacacctaagttcagtgcagcaataccacgtgcgaaaccaacacctagtactgcaccaaccagagtttgcgtagttgaaatcggtaagcctgtgcctgacgccagtacgacggttgaagcggttgctagctgggctgcaaaaccacggcttggcgtcaattctgtaatgccagtaccgatggttgccatcactttgtgacctaatgttgcgagaccgacgacgataccaaaaccacccagaggaagaatccaccatgcgatagagctcttcgcggccacttcacccatgtgttcaacggttgaaaccaccgcagacaaaggaccaatcgcgttcgctacgtcgtttgagccgtgcgcaaaagccatagcacacgcggtgatcaccatcaggatactgaagatgctttccacacccgcgaaaccatggtcttcatcgcgattagcaaatttcttctgaatgtagagatagccgccgaccatcacgatggcagaaaccaccgcggaccacatccaagcttctgagctcgaaagatgcaggccgacgtgtttaagaccttttttgatggtaaccagagcaatcaccatagtggtgatgaacatgtataccggtacgaaacgcttggcattgatcagcggtttttctgtatcgaaaatgaggcgttgtgcgctgacaaaaatgaggtacgcaaagaagcctgaaatcaccggagtaataatccaactgccgacaatgccttttactgagctccaatcgaccgcttctgtaccgacagaaacgcacgcgaaaccaataatagcgccgatgatagagtgagtggtagagactggccagcccatgtaagacgccaccagtaaccaagtgcctgcggcaagaagcgctgacatcatgccgtaaatcagcacatcgggtttatctgcgaagagagaggtttcaatcaccccattacggatcgtttctgtcacttcaccaccggctaagtaagcgcctgcgaattcaaaaatcatcgcaataataatggcttgtttaacggtgagtgcttttgaacctactgaagtgcccattgcattggcaacatcgtttgcaccaataccaatcgccatcaagaaaccgaagacagctgccacaataatcaagacggtgccgtagttcgcaaggatttccatcgtaatacctagttgttgataacaagcggagcaacccaagcttgtttttgacgcagataacgaccttcagcgtagaaaatactcatcgcctagcaggtcgtcatactgtggttgctcttcgttatttggttaacttttaaatttaagaacgagaaagcataagctctaagcgagcaccaacgcgctgcgcttggtcggcaatgccgcccacccattccagaattttgtacaagaacatgacatcaattggattcattttcgattcgatggccatcagctgttggcgtaggcgaatctgcatggaatcggtgtcatcttcaatcacatccagttgatggatcatttcagccacgagagttacctcacgacctttgaatccagtttccaataactcgtcgagctcgttgatcacattctgcgcttggttagccgcatctaagcaacgtctaacataagcaatgaagttttcttggagaggctcagggatgacaagctgacggccatatacacggcccgcaatgtctttggcgaggtttgctaatttatcttgttgagtcagtagttccagcatgtcactacgatcaaccggcatgaatagaccgcgaggaagtttaaggcggatttcacgctttaacacgtcagcttctttctctaggtgagaaatctgtgcacgaatttcgcccgctttttcccaatcacctttgttacaaacttcaaagaaattgatcaggtgtgagcaacattcattcacacacactacgtggcgttgcaaaggcttaatcggggactttgcaaataaccccatgattgtatttactggcatggtcattcaacctaataactataaccttgaaataacatacaccataatatggtgaaatgttgagcgttggctataaaggcgcgcatgttaacccaaacaccgtcgcaataaaactgttttagatcatgattgggccgatatttctctcttgctccggtgtctataaggcaatatcctgtcggcatctgcatcgaaagggataactatggaaaccgagatagaactgaagttttttgtttctccagatttttcaaccatcttacgcgcgaagatttctgaaaccaaagttcttcagcacagctgtcgggagttaggaaacacgtactttgatacccccgataactggttgcgtcagcatgatattggactgcgcatccgtcgttttgatgaggtgtatgtccagacggtgaaaaccgcaggtcgtgtggtcgccggtctacatcagcgtccggagttcaatgccgaacatcacagtaatgagcccgatctttcgctgcatcctgccgatatctggccgcaaggaaaagagctgactcagctacaagccgaactcatgcctctcttttcgaccaacttcactcgtgaacagtggttgattagcatggctgatggtagccaagtggaagtcgcctttgatcaaggtcttgtggtggcgggtgatcgccaagagccgatttgtgaagttgagctggaacttaagtctggtcaaaccgatgcactgtttaccttagcgcgccagctttgtgagcatggcggtatgcgcttagggaatcttagcaaagcagctcgtggctatcgcctcgccgccaattattcgggcgatgaaattcaacccatggccttggtcagtgtcgataaaaatgacactgccgagtcttgctttatccgtgctttagaacatgcgttagcgcactggcattatcatgagcaaatctataccgaacgtgaaaacgtggcggcattgcacgaaattcgtcatgcagtgagttacctgcgccaactgctttccgtctacggcggcatcattccgcgccgcgccagcgcgattttgcgccaagagctcaaatggttagagcaagagttacagtggctgaaagagtttgaatatctggaaagtttgcaagaagacaaaggttacgcgctgcgtaaactggatgcgcgtaagtttttagtcaccgcgttgaaaaccttgcaagagagtctgccacagcgtgaagatacactgcgtttactgagcagtgcccgttataccggcttgttactggatctaagtcgttgggtgctgacacgtggttggcagccgtttttagatgacaaagcacgcgaaaaaatggcgcagccgctggaagcgttttccgtaaaacaacttgaccgcacatgggcggagttgatggaagcttttccaccgggtaaaaccttaaccgtacaagaatacctcgatcagcagtatcgcctaatgcgtaacctttacactggggtgagttttgcaagtttatacgatgctgaaaaccgtcaggcatttcggatgccgtgggcggatttgttgcacggtattgatgatttattgcgcctcaaaccattagagcgtttggtggatctgctacaaggtgaggagcaagatcaactgaaacgttggctgattcgtcaagagaactccattttgcatgcgatggagcaaagccgcacgatgggtgttgaagcgcatccgtattggcgtgagtagctctggttaacgcattgatatagataaataagggaggcggaggcttcccttttctttttatcgcgtttccccatctttgtgatccttcactatgcatacccacatctcgttatcgcgagaaaagactctagatacgccagtttatgccgataacacatagtgagtttgatgagtgatggatagagacaatatccccttcctttttgaagctgcagtggtgttggctacgttcgttcaccccactcacatagtctgtctatgcccattgatatgaacgcacttgacgcctacctgcaactccaagtcgtttgggtataagtcaaagatcacaaatagcgtgatgaataagagaattagcgataacaaactgatgggttttgtttcatttttgatattatcggctttcatacgaggctcgaaataataggttgcggatcttttgcatcctcactcagtggcaatcaaaaagaatggagaactgacaatggcaacgatgtcgtttaagccgtgggagcgggtaattacagatgttcgtctcgtcccgaaaatggtgatgctgatggtattcagcacggtgttgatcattggcaagcagctttgggacgcggatatcttttaccaatctttattggcggccaccaacagtgtggaagtcgcacagcagcactacgataactatctggttcaagtgttctggcaaaccttgttactgattgtggtgtttgtggtgctgttgctgtttgccgcgcgcgtcatgctgcgacaaactcagtatctgagtgatgtgatcaagctgatggcgcagcgtaacctctcagagccgatcaaaatggattgtaaagatgagtatggggatgtcgcgcgcgagttggagaaaacccgccgccagctgcaagacctgatcaagttgcaaattgatgcctcgcaagagctgacctcgctcactgaagtcatgaccatgagcatgtcggagaccaaagattcagcgcaagaagagttcaacgaaattgaccaactggctacggcgatgagtgagatgtcgtcaacggttcaaacggtcgcggaacatgcgcagaacgcctcttccttaaccgaaaatgcgtctcagcaggctcaaaccggtcagcagtttgtcaaaagcaccatcagtaaaatgagtgagctttcgaaagacatcagctcttctgcgcaagccgtcaatcaggtggaagagcgagtggtggcgatcagcagcgtagtgggcacgattcgcagcatttcagagcaaaccaatttgctggcactgaacgcggcgattgaagcagcgcgagcaggagaagccgggcgcggttttgccgtggttgccgatgaagtgcgaaatttggcacagcgtacccaaaatgcgactgttgaaatccaagagatgatttcacagctgcaaagcagtgccaatagcgctgtgaatttaatggaaaaaagtgtggtgcaagcagcggatggggtagagctcatcaccaacgctggtagcgagttggatggcatcgttaatcaggttcaattgctcaatgacatgaacttccaaattgccgcggcagcaggccagcaaagtaatgtggccgaagagatgaacgaaaacctcaacaatgtgcgtgagttggtggaaggttcggtcactgtgatgactgagctgctcgaaacctcagaaatcatgcaaagtaacgctgaagagctggatagaaaaattaccgcatttcgcgtgtaggctgagctattgagcaaaaccgcaaaaaattattcgtcaagcgcccacaactgctctgtgggcgttttttttccgccagagtttgcgatataactagtgaacattcaaagacaaggaagcatcatgtcactgcctagcgcgcttttgccgaccgccgaattgcattatcaatcactgatttctgaacatccacacatcgccaattggccttcatctgtactgaatcaattgcgctatgtgctcggtttaagccagtttgtagcccaaaccttgcagcgcgatgacccattgtgtcaggtgctcccctcgttattagccaagccaagccgtgagcaatattatcgcagtgaattagcgcagtggctggccgagtgtcaggatgaagcggtcgcgcagaagcgtttacgccagtttcgtaaccaagagatggtgtatatcgcatggcgggatttttgtgcgagctggacattagaagagagcctttctcacctttcccaactggcggaagcgctgatctttgaaagctatcaatggctctatcaacgctgctgtctggaaatgggcacgccttgtaatgcgcaaggggaagcgcagcccatgctgatcatcggaatgggcaaactcggtggcggtgagctcaacttctcctccgatatcgatctgattttcacttatcctgaaaatggcgagacgcaaggcgcgcgccgctcgattgccaatgcgcaatttttcacacgcttaggtcagcgcttgatcaagctactggatcaatccacaccggatggtttttgttaccgagtcgatatgcgcttgcgcccgtttggtgacagcggcccactcgcgatgagctatgccgcattagaggattactaccaagagcagggacgtgactgggaacgctacgcgatgatcaaagcgcgagtgatggggcgggaaatgtacccgcaataccaagagctgcgccagatgctgcgcccgtttgtgtttcgccgctacattgacttcagcgccattcaatccctacgccgaatgaaatccatgatcagcagcgaagtgcgccgccgtggtttgagtaacaacatcaagctcggtgcgggcggcattcgtgaagtggaatttattgcgcaagtgttccaattgatccgcggtggccgcgagccaagcctgcgcaaacgcggcttgctagaaaccttggatgcaattgcggagcttgaactgctaacgcgcgaacaagtgcaagatttgcgtgatgcttaccgctttttgcgccgcttagaaaacttgctgcaagcgatggccgataagcaaactcaaacgttaccggataaagaagacgatcagttgcgtctttcgatcgcaatcggattggccgactggccaagtttacagcgtgaggtgagcgagcacatgcagcgcgtgcatcgcgtgtttgccaccttgattggcgaagaagacgaagaagaggaacacacggtagctcgtcatttccatgagctgtgggatatggcgcataaaccggaagtgattgaacacatcattgagcaagatcttgggttgagcgacgcaggtgagcaaattcgcaccatcactcaatttaaagatgatctggctaaacgcaccattggtccgcgtgggcgcgaggtgcttaaccggttaatgccgaaagtgtatcaggcggtgtttgctcatcccgatgcagaatttggtttgtcgcgcgtattggcattgctgcacagtatcgccacacgcaccacttaccttgaactgctcgatgagcatcccgctgctctggtgcaattggtgcgcttgtgtaccgctagcccaatgatttccgagcagctcgcgcgttatcctatcttgcttgatgagctgattgatccacagcatctgtataacccaattccattggagtcttatcaaactgagctgcgggattttctggcgcgcattccagaagaagatatggagcagcagatggaagggctgcgccaatttaagcagatttcgatcctgcggattgccgcagcagatatcgcaggcgtgcttccggtgatgaaagtgagtgaccacttaacctatcttgccgaagcgattgttgaggcggttgtgagccaagcatggctgcaagtgagcagtaaatacggtgagccgacccatcttaaacatcgcgatggccgaggttttgcggtggtgggctatggcaaagtcggaggctgggagctgggttataactccgacctcgacatcgtatttatgcacgactgcccagttgaggtgaacacggatggtgagaaaagcattgatggccgccagttctatctacgtttagcgcagcgcatcatccatattttctctacccgcacagcctcgggcattttgtatgaagtcgataccagactgcgcccctctggtgcatccggtttgctcgtgagtccaactgatgcctttgatgaatatcagcgtcaagaagcatggacttgggagcatcaagccctagttcgcgcgcggatgatctatggtgatgcgccgctgcaacaagcgtttgccaacacacggcatcagattctctgtttgccccgagaggagcacaagcttaaacaagaggtggtcgagatgcggatcaaaatgcgagatcatctcggcggtaaaaaagcggggcgctttatgctcaagcaagatgaaggcgggatcaccgatattgaatttttagcgcaatatctggtcttacgcttcagtcatcaacaacctaagttaacgcgttggtcggataacgtacgcatttttgaatccttgatgaaccatcaagtgatgagcgagtcacaagcgctggctctgactcatgcctacaccagtatgcgcgaccagattcatcgccgtaatttactcaatcaatcggccgatgtgcgagattcacaatttgtggttgaacgtgaacaagttatacaagcttggcagcagtggctcggttgagcacttctgccaccttggcggctgtgataaactccgccccaatctgaatattggagattgagaatgaaaccagtgctacctgactacagcaaagcgggtgtgttaattgtcggtgatgtcatgcttgaccgttactggtatggcccaacgggacgtatctcgccggaagcaccagtacctgtagtgaaagtagagcagagtgaagagcgtccgggcggtgccgctaacgttgcgatgaacatcgcttctttaggtggtcacgcgcacatcattggtctgacagggcaagatgagccggcgaatgtgcttgccaacaagctcacctcactgaaagtccattgtgattttgtggcgctgccggattacccgaccatcactaaattgcgtgtattgagccgcggtcagcagttgatccgtctcgattttgaagacaaattcgaaaatacggatgcgcagcttatcttatcgcgcatggaaagtgcgctacctaaagtgcgcgcggtgatcctgtctgactacgcgaaaggtgcgttagagcacgtacagcagtttattcagaaagccaaggcggctggtgtacctgtgtttatcgatccgaagggcagcgactttgaacgctatcgtggtgcatcgctgcttacgccaaacatgtctgaatttgaagctgtggtcggcaaagtcaaatctgagcaagagctggttgaaaaaggttttgccctgattgaaaagttcgatctcggcgcattactggtgactcgtagcgaacacggtatgacgctgctgcgccgtggactggaacctttccatttacccacccaagccaaagaagtgtatgacgtgacaggcgccggggatacggtgatttctgtgcttgcggcgtcggttgcggcaggtaaagcgctggatgaagcttgtgctctggctaatgctgccgccggtgtggtggtcggtaaactgggtacgtctactgtttctaccattgaattggcggaagcagtgcacggcagtaaagacactgattatggcgtgatcagcgaagatgctctgattgaagccgtgaaaaaagcgcaagcgcgtggcgaaaaagtggtgatgaccaacggctgctttgacattttgcacgccggccatgtttcttaccttaaccatgcagcagagcttggcgatcgcttaatcgttgcggtgaacaccgatgaatcggtgaaacgcttgaaaggccctggccgtccggtcaacagtaccgatcgtcgtatggcggtattggcgggtcttggcgcggtggactgggtcgtgccatttagcgaagatacaccacagcgtttgatcgcagccgtattgccaaacctactggtgaaaggtggcgactacaaaccagaagatattgcgggtggcaaagaagtgattgccgcgggtggtgaagtcaaagtattgaactttgaagaaggctgctcaaccaccgaaatcatcgaagcgatcaaaggtggtcgtggttaacgtggattgataagtaatgtgatacttatcaattacttaatcgatatatagcaaaaggggccaaatggccccttcatttatttcatgcagctcaaaagagatggattacttcttcgcgacttttaggcctgcgttgacatccatcacgtcttgctcactcagagtaccaatcgcttggcgcaattgcagcacactgagaatgtagtcatagcgagcattcgagagatttttgttcgcatcatacaggcgacgtgtggcatcgagtacatcgacaatggtacgcgtaccgacatcaaaacctgcttcggtcgcttccagtgctgacttcgcagaaatcactgcctgctcataagcacgcagtgcaccaattgaagcgttgatgttgttgttgtatgcacgcacatctttaaccactgagcggtaagcggcttccagatcttggctggcggctacatacgcaaattcagcctgcttggtcagtgacgtggtgttgccacctgtgtacagcggtactttgaggttcacgccgattttgaaatcgttgtactcttcgcctgaagtgtttttcgcattgtcgttgctattgttgccatagttgtaaccaccatctaaggtcagtgatggcagatggccagagctggcaagcgaaatgttgtcacgtgcgacatcttgactgatacgagcagcaagcagcgataaattttgctgttgcgctttttcgatcaacgcttcgcttgattcggtcgtacgactcgccgcaaatcgtttggtatcgagtaccgcaagcttagagtattcctgacccgtaatttcacgcagagcttcatagctattggtgaggctgttttccgccaacacttcatcggctaatacaccatcgaattgtgcctgtgcatcatgtacgtcggtaatcgctgacaaaccgacttcaaagcgttgtttggtttgctctaattggcgacccacggcggctttttctgcgcgcacgaattcaaggttatcttgagcgcggagcacttcaaaataagccttcgccacacgtaagattaagccttgttgcgtggcagcgtattgagagtctgcttggcgggcttttttctcagccgtatctaagcttacccagctagaacgttggtacagttcttgtgaaaagttgatgcctgcagagagaagatcactttcgcgtggggcttgatcactgcggttgatgttgtaacccgccgtcagattaatttgcggtaaaagggcactacggctagaagtcaccgcttcaaacgcagcatcacgttgagccgctacgctgagtaattggggatcattttcttttgcttggttataaatctctgccaggttttctgcccaaacggcagagcttagtgtgcctagcgcagcactaacaaataatggaagcagttttttcatcggtcctattcctgacgtgatgtgaaaggatttattcctcaagagtttaactcaaattgatggtaattcactcgaaactttgcacttttttacacttaactatccaactgtgcaataaaaattatgagccacttaaaaaataagataatttttatataaaaagttgagccatcacttggtagtcggcaaattccacgagtaaactataaagttcatcaataggaggtacgaatgcaagacgcgaatcagcagccagtctcttttaataagaaagatgtcgaaatccttaataaagagacactgtttaaaggctttttccgcatggtgaagtaccgttttaagcataaacgttttgcgggaggctggagtgagcctgtcgagcgggaaatgtttgaacgtggccatgccgcggcgatgttgccgtacgaccctattcgtgaccaagtggtgatcatcgaacagatccgcgtcggtgcgctagaacatgcacagccttggcaactggaaattgtcgctggagtgattgataccgatgagagtgctgaacaagtcgtgcgccgtgaagcggtagaagaagcagggctgactgtaggcagaattgaaaaaattacctcttattatccttcttctgggggatgttctgaaaaattggatgtctttataggtgaagtcgattgttcacaagcgggtggcattcatggtttagactgtgaaggagaggacatcaaagtgcatgtgatgagtcggactgaagcgtatcaattggtcaaagatgggcgaattgaaaatggggcatcaatcattgccttacagtggttggcgctgaattatcagccattacaacagcaatggcagtaacgagtaatgagtcaattgacagttaaaaaaccgtatcatgttgatctccctgaattaatgcgggtatatgagaccaactacgccaaactgaatgctctgctgcctgcgcagccggaggtcggagaggtgcgttgttaccaagctgctcaaatgacctatcaactgcaagtgctagaggtcacaaagtacacaactttgttggaggtctgtcaaagtgatgacttgtcagtatttccattgccgaccatgtctgtcaggctgtaccacgatgctcgcgtggccgaggtttgcagtagtgaacagttaggtcgagtgcaagcgcgctatgattatccgaacgaaaacatggtgcaacccgatgaaaaagcgcaactgaatcgctttttaggcgattggctgactttttgcctcaagcatggcatcagtcgcagtccaatcaccctatcacaataaataacagagttaggtttaccgattttgaaagtgtcgtctcaatcagaggattcatcgatcaagcttattcagatcacggacacccatttgttcgcggcggaagatggtagcttgctcagtgtgaatacggctgacagctttgcggctgtggttgcggccattggtgaagagcaggtcgaatttgatgccattctcgccaccggggatatttcgcaagaccacacacccgagtcttatcaacgctttgtgcgcggtattcagccgctaaaaaaagcgtgttattggctgcccggtaatcatgattacaaaccgagtatgcacagcgtactgcccactcagcaaattcaagccgttgaacatgtgctgctgggggagcattggcaagtggtgttactcgattcgcaagtggttggcgtgccgcacggcaaactgagtgagcagcagttacaactgctggataacaagctgaccgagtacccagagcgtcacactttagtgctgctgcaccatcatccgctcttggtgggaagcgcttggcttgatcagcacacactcaaagagagcgagcgtttttgggatgtcgtcgccaagcacagtaatgtgaaagccattttgtgtggccatgtgcatcaggatatggatcgtattcaccttggcgcgcgtgtgatggcgaccccctcaacctgtgtgcagtttaagcctaattcacaagatttcgcgttagataactgctcacccggctggcgtgaattaacccttcacgcggatgggcaagtgagcacccaagtgaagcgacttaaacaaggccgatttttacctgattttaactcgaacggatactgatatgactgctcgtcctgctttgctgctctacatccatggttttaacagctcaccgttgtcacacaaagcgcaagtgatgcagcagtattgccagcagcacaggcctgatatcaaagtcgtggtgcccaagttaccgagctttccagcgcaagcggcgcagcatctgttgtctgtcgtggagcaatatcgcgcgcaatatcggatcgggttggtcggaagttcattaggcggttatctctccacttggttaaatgcccaatttggctttcgctcggtactgatcaatcctgctgtgaagccttacgagttattagccgattttctcggtgagcaggttaatccttacacccaagagcattacgtgctcgaagcgtgtcatattgatgagttgaaagcgctcgatacgccagtgctgaaacagccaagcgatttttggctactgcagcaaaaaggcgatgaagtgctggattatcgacaagcggttgagaagtaccaagcggctaaactgaccgtggaagagggcggtgaccacagttttgtggattttgaacgttacccagagcagattattcacttccttgaactttgattgatgactgacttttgttgttttcggattcaatctgcgttttgctgcgcaaagcctcataaatttacctgatccttgcgctgtgcccttgacatcagagggcggcttccagactatgttgcccttagactttagcgccaactgtgaggcggtgtaagggcagaacgcgagcttgcttggtcagtgtcctctcgctcccatcgttcagcttgctgaaatgaacacctgaaataatgcgatttttcgcacaatttatgcacaaaaaatcaggttttcacacggcgctgataaagttaccaatcattgagcaaataaagcattccgtattatgactgaacaatataatgctggggccattgaggttctcaatggcttagaaccagtgcgtcgcagaccgggaatgtataccgacaccacgcgccccaatcaccttgggcaagaagtgatcgacaactccgtcgatgaagcgctggccggatacgcctccaaaattcaggtaattcttcatgccgatcaatcgctcgaagtgattgatgacgggcgaggcatgcccgtcgatattcaccctgaagagaaggtttcaggggtggagcttattctgtgcaaactgcacgccggtggtaagttctccaacaaaaactaccaattttccggtggcttgcatggggtgggtatttcggtggtgaatgcgctctccaaacgggtagaagtggcggttcgccgtgatggtcaagtgtatgaaattgcctttgaacatggcgataaagtgactgagctgacggttacggggacttgcggccgtcgcaataccggtactagcgtccatttctggccagacaccaaatattttgactcaccgaatttctccgtatcgcgcctgattaataacttgcgtgccaaggcggtactttgccccggtttagaaatcatctttaccgataaggtcaataacaacgagcaccgctggttgtacgaagatggcctaaaagattatctggccgaaggtgtgaaaggttataccttactgccggaagagccgtttaccggcgaatttactgcgcaaaccgaagcggcaacgtgggcggtgatttggctacccgaaggtggcgagctgatcaccgaaagctacgttaacctgatcccaaccgcgcaaggtggtacccatgtcaacggtttacgccaaggcttgctggatgcgatgcgcgagttctgtgagttccgcaatctgctgccacgcggggtaaaattgacaggcgaggacgtgtttgatcgctgtgcttatgtactgtcgatcaagatgcaagatccgcagtttgctggccaaaccaaagagcgcctctcttcacgccaatcggcggcgtttgtctccggcgtggtgaaagatgccttcagcttgtggcttaacgaaaaaccgcaactggcagagcagttagccgaagtttgtattgctaatgcgcacagccgaatgcgtgccagcaagaaagtggtgcgtaagaagatcgcttcaggccctgccttaccgggtaaattaaccgactgtacagtgcaagaccttaaccgcaccgaactcttcctggtggaaggggattcggcgggcggctcggcgaagcaagcgcgggatcgtgaattccaagcggtgatgccactgcgcggtaaaatcctcaatacgtgggaagtttctgccgatcaagtattggcttcacaagaagtacacgatatttcagttgcattggggattgaccctgacagcgataacctcgaagcactgcgttacggcaaagtctgtatccttgcggatgcggactcggatggtctgcacattgcgaccttgctctgcgccctatttacccgccatttccgcgcgctggtgaaagcgggtcacgtctatgttgctatgccgccgctctaccgcatcgactgtggtaaagaggtgttctacgcactcgatgatcaggagaaagagggcgtgttagagcgtctgagccagaaaaaagccaaagtgaacgtgcaacgctttaaaggcttgggtgaaatgaacccgctgcaattgcgtgaaaccacgatggatcccaacactcgccgcttggtgcaactgaccattgatgatgcagaagcgaccgacgagatgatggatatgctgctgggtaaaaagcgtgcggatgaccgccgagcttggctgcaacgtaacggcgatatggcagaggtgtaacgaatgtctactgaaatcagctttgatggcgttgaacagctgccgctgcgcaaatttactgaagacgcttatctcaactattcgatgtacgtcatcatggaccgtgccttgccctacattggtgatggcttaaaaccggttcaacgacgcatcatctacgcgatgtctgagttgggtctctcggcatcggccaaatacaaaaaatcagcacgtaccgtgggtgacgtactgggtaaataccatccgcatggcgatttggcctgttacgaagctatggtgttgatggcgcagccattctcttatcgctatccgttagtggatggtcaaggtaactggggtgcaccggacgatccgaaatcgttcgcggccatgcgttataccgaagccaaactgtcaaagtttgccgagattctgcttagcgaattaggccaaggcaccgtagattggcaaccaaactttgacggcaccatgcaagagccgaaaatgttgccagcgcgtctgccgcacattctgcttaatggtgtcaccggcatcgcggtaggtatggcgaccgacattccaccgcacaacgtgcgtgaagtggcggatgcaaccattcatctcatcgataatcctaacgcgccgctgaccgatttaatgcagtacgtcaaaggcccagatttcccgactgaagcggaaatcatcaccccaacggttgagctagagaagatctaccgttcgggtcgtggcagcatcaaaatgcgtgctgtgtggtgcaaagaaggctcggatatcgtgatcaccgcgctgccgcatcaagtctctggcgcgaagctgctggagcagatcgccgcgcagatgcgtgctaagaaactgccgatggtggaagacttacgcgatgaatcggatcacgagaacccaacgcgtatcgtgatcgtgccgcgctcaaatcgcgtcgattgcgatctgctgatgaaccacttgttcgcttcaacggatctggaaaagagcttccgcgttaacctgaatatgattggtctcgacaatcgtcctcaggtcaaaggcttagtgcagatcttgagcgagtggatctcgttccgccgtgaaacggtacgctcacgtttgcaatatcgcctcgataaagtgctggctcgtttgcacattttgcaaggtttgctgatcgcttatctcaaccttgatgaagtgattgagatcatccgtaacgaagacgatccgaaagcggtgttgatggcacgctttgatctgaccgatattcaagcggacgcgatcttagataccaagttacgccacttggctaaactggaagagatgaagatccgcggtgagcaagatgagctagaaaaagagcgtaaaaaactggaagagctactcggctctgaacgtcgcctcaataatctgctcaaaaaagagatcaaagcggatgccgacaagtttggcgatgatcgccgctcaccactggtcgaacgcgaagaagccaaagcgctgaccgagcgtgatttgatgccaagtgaagcgatcaccgtcgtgctgtctgaaaaaggctggatccgtcacgccaaaggtcatgatgtggattgccagagcctgaactacaaagcgggcgataattacctgacccatgcctgtggtaagagcaaccagcaagcagtgttcttgggcagtgatggccgtagctactcgctcgaatcgcacacgttgccatccgcgcgcggtcaaggtgagccgatcacggggcgtttgaacgtagctgaaggcaccacgattcgtcaggtggtcatgggcgaagaagatcagctctggctggtgggctcggatgccggctacggctttgtgtgtaaaggcgatgacctgctgtcgaaaaaccgcagtggtaaagctttgatcaatctaccagaaaactcggaagtgatgacgccacaagtgatcgccgatctcgataacgatgagattttagcgattactaaccaagggcgaatgttgctgttcccgattaaggatctgccgcaactgagcaaaggtaaaggtaacaagatcatcaacattcctgcggcgaaagcgaaaacccgtgaggaagtgctgtccaacttgatggtgttgccacaaggcgcatcgattaccctatatgcaggcaaacgtaagctaggcttgaaggtgagcgatctggataacttccgcggtgaacgcggccgccgtggtgctttgttgccccgtggcttgcaacgcgtgaccgcgattgagattgaaacctcagcggagccagaatcgaccccgcattcggaagatgaatagacaagaggagccatctggctcctctttctttactctcaaccccgtgaactaatactgatcttctgaccagccatcgctgtcggacatatccggtgcgccgggaatggctttctcttcatctgcccattcaccaaaatcaatcatttgacactgcttactgcaaaatggacggtgtgggctctgttcgccccattccacatcggtgccacatcgtgggcatttcactatggtgagttttttggtcataacgcagtcctattgaaaagcagccatggcttatccccttaaaaccggcaacgccaagttgtgtggggatactcttcatcaaagccaagctgataatgtatttttggttcgcaacattgtttcgagaaaaggtcgcgagttttagcagcacaccgccaaatcaaaggcgatatcttgagtgcaggcttgcccgctgtgaaaatcgataaacttgatagcaaagcggtttttgtgcccagaaatcatcgggtacacaccgtattcgagcggaatcgcaaggcgtaggatattggcatcttccgcatcactttggtagaaaccgttgcttgccatgcgtgagcggtagtggccggtttcgcgagtcaatttaagccagagtttgagtgcattcgaaagcggcgtcacggtttgcatccactgctgggcatcacgcattttgcgatccagcggcagatgcagccagtagtgcagcgctggcagatcaaaacagcaggaaccacccggtaaattaaagcgctgacgaattgcactgaggaaacggtcttctttgagtgattggccaaaacgctcggcactcatcagatcccgatgaacttcatcgacttcggtgagcagcgagttaagcatctcttgatctacgccttctacatggagccaactgcggtatgttaagcgctgtttttccatatctttagccagttcacttttcagttggatctgctcaaaaatctccagcatatcgaacagtgagcggaaaaagagttgatgttgaatcccatcactgaaagtggacgctcgctccatctgattgagcagcgcttcgacacgcaggtagatgcgcgttttttcattgagagggtgttcaaactggtgcgtagtcattgggctagccttggattctttgcgcttattctcacaaattttgcctgctcatggctagatacttttggtgcaatagtgtgatttgaggcaaaagtttctggttttctgcgtcatttttgagcacatcatcagcaatcgccaaacgttgagcgcgtgaggcttgcgcagcaaggatagcctcagcttgttcgcgtgatactttatcgcgtgccatggtgcgctcaatctgtattttttcatccacatcgaccactaacacgcgatcggccatggtttgcagttggttttcgaccaacaggggcacaatcaacagcgcataaggtgaggtcgtttgggtaagcgcgttgcgcataccttggcggatcatcggatgcagcagttggtttagccacgctttttcattaggggcggcaaagatgcgttcacgcagcgcggcgcgattgagtgagccatcagggtgcaagatggcttgcccaaaatgggcagcaatcgcttttaatccttcggtttccggtttaaccacgtcacgtgcgatcacatcggcatcgaccagatcaatgccaaactgatcatgaaatagattggctaccgtggttttgccactggcgatgccgccggtcaatgctacgacaaaactcataacggttgtcctacccaagtggtgaagtaccaatcaattaccttatcgccccacagcaaggcaaaccatcccgcgatggcgagataagggccaaacggaaaggccatatcgataccttttttctgctggcgcagttggattaaaccgaaaatcaccccaaccaccgatgagagcagtacgatgacaggcaactgctgccaacccagccaagcgccgagagcggcgagcaatttgaaatcgccataacccatgccttctttacctgtcagcagtttaaatagccagtaaatcgaccacagcgagagataacccgccatggctccgatcaccgcatcactgagtgaaacaggagaaaaaccaagcagtgccagtgcaataccgccccacagtaaaggtagcgttaattggtcgggcaacaacagggtatcgaagtcgatgaaggttgccgcaatcaacacatagctgaaaaacagcagcgccacggcaaaaactccgaacggaaagtgagtggcaatcactaagctcatgagggcagtgagtagctcaatcaagggatagcgagcgctgatcggcgctttacagtgtgagcattgaccgcgcagcgctagccaactcagtagcgggatattatcaatgacgcgaatcggcgtttgacagtgtgggcaagtggaacgcggcaaactgagggtcagtttaccctctggtggcgtgatgccatattcaggaaaactcgccgcacattccgcgcgccattcacgctccatgattttgggtaagcgatagatcaccacattgagaaagctaccgacaatcaagccaaacagcgtggcgagcaccggaaacagccaagggtagaagtaaaacagttccattctcttgctctaagcgaaatgagggcgcgctcaatgggcacgccgtttgtcgccatactaacccaatacactcattaagttaaagataggtaagtacatcgccaccactaagccgcccacaaccgtcccaagaaagacgatgatcagtggttcaagaatcttgcccaagttatcgaccgtgttatcgacttcaaattcatagatggtcgcgaccttgttgagcatgtcgtctaattgcccagactcttcaccgatcatcaccatttgcagcaccatttcgggaaaagcttcggtattgcgcatagcaatgtacatcggcatacccgcagcggtatcgcggtacacctcattaatcgcggtttcaaagtgcacattgccggaggttttggccgtggtttttaaactggcgagaattgggatccccgcggcaaagctggtggcgagggtacggctgaatttggcgatggaagccttagcgagcacattaccaataatcggaaatttcagccctaagcggctggtttttaaacggatctggaaagagtttttacgcagcgctttcaagccaaaaatggctgctgcgatggcgataaatgcccataaactgtaagcctgcacccagtgtgagagtttcagcacttgctgcgtaaaccaaggcagttcagcaccaaagcctttaaacatgctttcaaactctgggatgaccatggtgagcattaagtaagataccccgagcgcgaccaacacaaccatgctggggtagatgagcgctttaatcaccttggcgcgtagttgctcgcttttctcgcggtaggtggccaaacgctcaaacacctcaggtaagttaccggacatctctccggtttccactaaatcgacatacaaggtatcaaaatgggcgctggcggtgcgcatcgccttggaaagtggcgtgcccgcttccacgcttttggtgatttgcgccagaatcgatttcatctcagctttacggtgattatcgcccaccaacttgagggcttgcacaatgggtacgcccgtggtgagcatggtcgccaactgccgagtcaaaatcgtaatatctttacttttcacgcgatgggttaggcgtgccaaaagagatacactgccttttttgagttttttgatctgaatatgctgatctttgagcttatcgcgcacctcgatttcggagatggcgagcatctggccggaaacttttttgccgttgctgttgatgcctttccagcgataatttttcagaggtaaggtttgggtcgctttcatgttgaggctcgtgctgacaggttaggttatcgaataaaacagttaaaagtagagcacacgctgcagctcggcaaagctggtgatgccttcgcgcagcttttcaagaccggactcttgcaacgtttgcatgccattggctttggctaaacgttcaatttgatgaatgctggcgcgttgcataatggcctccgccagctcggtattaaacgccatcacttcatagatcccaacgcgccctgaatagccgcccgtacactcgttacaccccgccgcattcgcttcatacaagatttcattgggttgaaatgcaaattggctttgcaatagggcagaagggcgcaccgcgattttgcagtgtttacataggcggcgcgcgaggcgttgggcgatgattaaactgagtgaggacgcgaggttaaacggctccacccccatattggctaaacgaattacggtttcagcggccgaattggtgtgcagggtggaaagcactaagtgaccggtttgcgcggctttgaccgcgatttctgcggtttccagatcgcggatttcgccgaccatcaccacatccgggtcttggcgcagaaacgagcgtagcgcttcggcaaagccaaagccgattttcggctgcacttgcacttggttaatcccagagaggttaatttctaccggatcttccgcggtggagatattgatctgtgacgtgttgagaatgcgcagcccagtatagagcgaaacggttttgccgctgccggtggggccggtcattaaaatcattccttgcggtcttttcagggcgttgaggtagagttgcttttgctgcgggttatagccgagcttatcaatatccagattggcggcgctgctatcgagcagacgcagcacgattttttctccccataaagtgggaagtgtcgaaacacgcatatcaatggcggtatcgcggcttaggcgcagtttaatccgcccgtcttgcggcaagcggcgctcggcaatatctaatttggagagaattttaatccgcgcagctaaacggcggcttaaatggctagccggttgctgagtttcgaccaagatgccatcgcagcgcaggcggatccgatactggttttcatacggctcaaaatgaatatccgaggcacctttacgtaccgcatcgagcagcacttggttgataaagcggctaaccggagagtcatcttggctgagatcttcaatggattgcagctcgtcgtcactgactttaaccagattggcgagctcatcttggctgatctctttcccttggttggctgcgccttgaattgagcggccatacaaacggcgaatcgcggcttgcagcgcgcggtgatcggccagtgccagttcaacttgtaatcctgtggcaaaacgaaattcttcttcggcttgcagtaaggtcgggtcagagaccgcaagcagcaataaattgccttgcttggcaatcggcaaggcatcgtagcgggtaatcagttcacgcagcccgagctgttggcacaagttggcgtagtcgtagcggctaaggtcggtttccggcaagccgaaaatatggctcagttgttcggtcagttcttgggcgtgaaaaatacttaactcaagcagcgcctcgggcaccgaagtccccgaagcgctaacctgtgtaaccaccgcttgttcttgcgttgcgctgattaactcagcctgacgcaagatagcaacaaggttggtgagcattagttaattgttgcacctgcagtacagccttttggtgctatttcactagtaacggtggtactacaagtccataatccattggcatctcttgctaattggatttttgaactagatactacaccagcatcgaatgtgtattttattgtacctcctaatgcacctgatgctgttggggcaattacaatcttaccgtcacccatgtcttcaacagtacctaagcgtgtaaatcctgcggccgtacctgcagttgttgcaggaaaagagccttctgtcgcaatataatcttcaatattagttttcagtgctgtgatgtttgctaagccaaccccaatagctgatttttttacataattttgatattgaggaattgcaatcgctgccaacacaccaatcactgccaccacaatcatcaattcaattaaggtaaaacctttctgttgtttgtttttatacgctttcataatttcctccgtaggtgtttgcgtattaagcgcagtgagcatatgccttgctacacaaggggggaatcgagtcgcgagcgctcttcgagtgagttagggttttaacctattgatttgcatgatgaatgcaaaaaacttcgagtcagttaaaaacttatgcagctaattgagcgatgagaaataaaaacaggaggcttgatgcctcctgttaactgtttgaaatgtttgaagttagtctcaagtgttacgacttaaaacgcatcgacagatcaagggctttgaggtgtttggttagtgcaccgaccgagatgtaatccacaccggtctcggcacactctttgaggttatccagcgtgatattgccggagttctccagcgccgcacgcccggcgttaatctttaccgcttcacgcatcatctcaaggctaaagttatcgagcattatgatgtcggcaccggcgctgatcgcctcttccaattctgccaaggtttcggtttccacttccaccggtttgccgggattgagctgtttcgctgtgctaatcgcctgacggatcccgccacaagcaataatgtggttttctttaatgaggtaagcatcaaacacgccgatacggtggttataaccgccgccacacgccacggcgtatttcagtgcgctgcgcaggccgggaatggttttgcgggtatcgagcaatcggcactgggtgcctttgagctcttgcacataacgcgccgtagccgtggcgcaaccggaaagggtttgaataaagttcatcgcgttgcgctcaccggtgagcagaatacgcgcaggcccggttaaggtgcacaaggtttggttgggcgtgagggtatcaccatcttgcacatgccattcaatgctcacttggccgccgagctgtttaaacacttcatccgcccacaactggccgcaaaacacccccgcttcacgagtgatgatggtcgcggtgctgatgcgatcggctggaatcaggcttgcggtaatgtcggccgcagggtcaagtgtgccgcctaaatcttcctttagagtgtcgatcacgctgcgggtaatatcggcaggcagttgctgtttcaggtacgcaaggcgatcctgactgttgtgagtctctttcatcgcaagtcgaatgtccgtgttatttgctgtgttaaaccaaaccgcgtcatgatactggctggcgcgtagaaattcagcttctaatctcgtaatttgttaggtgtaaggtagaatcgggcgcaggttatccccttgctacttgaagctgcagcggtgttggctacgttcgttcactccaatcacagagttttcctatgctcacggggacttacttgccgcctagctgcaactccaagtcgtttggggataggcttggcgttactctcaaccgacaagatataagcaaggagtaaggatgattgatagtcaaggctggtaccgcctcgccagaaaagtaccttctccacattgtgatgtgcgccatgatagtgaggatatttcgctacttgtggtgcacaacatcagcttgccccccggccagtttggcggcccgtacattgagcagttttttctgggcgagctggatgccaatcaacattcgttttttaaggtaatcgccaagatgcgcgtgtcggcgcactgcgtgatccgccgagatggtgaggtggtgcagtttgtgccgtttcatctgcgcgcgtggcatgcgggtgtttcctcatttgcaggccgagccaagtgcaatgattactcgattggtattgagctggaggggagtgattttgtgccgtataccgatgcgcaatatcaggcgctgactgagctgacccaagccttgatggtgcgctacccgcacatcacgttgccgcgcattactggacatcaatatattgcgccgctgcgtaaaaccgaccccggtttggtgtttgactggcggcgttttcgggctgggttgaagtcataggttttagttggtgcgaaatacccctccctgcctccccctagaagagggaggggtaagggcggtgcttggttttgagttccctccccttagggggaggggttagcgcggggtatttaggcgctcgcggtgcttagttgctgggtttgcttggtttggtgtgaaatacccctcccgatctccccctataaggggaggggtaagggtggtgcttggttgagttccctccccttttaggggagggctagggtggggtattaagcgctcacggatgggcttaaatcgcatcgtgatactcggtcagcacttgctcgacccaagtcgcgatgcgttcgtcgctcaagtcatattgtgaatcttcatcgagcgcgaggccgacaaaatggctgccatcttcagtcaaagccttggaggcttcaaagtggtagccttgattcggccagtagccaagcaggttagctccgctcttcttgatctggtcgtgcagcagccccatcgcatccagataccattcgccatagccttcttgatcgcctaagccgaacaacgcgacgtacttgttttttagcgacacgccaccgatgtgatcccataccgcactccagtcctcttggatttcaccaaaatcccatgttgaaatgcccagcagtaaaagatcgtaatcactcattaaagtgagaggcgattcttttacgttgtggatatccaccagttcttcacccagtatggcgcgaattttctccgcggtcatttcggtgtaacaggtgcttgagccataaaatagaccaatcttcatcaataatttgtatctgtctgcgaaggaatggcaaattctaaccataaaaatgatcggaatgcagccaatatcctgcatcctgcgtatttttatgctattaaacgcccagtaaaaagagagctagagctgaggatagagtgagcgaagccttatctcccgaccaagggttggtggaacaatttttagataccatgtggtttgagcgcggtttggcagaaaataccgtggcgtcttatcgtaatgacttgagtaagctattagagtggatggcgcagaaccagtatcggctcgattttattagctttgctggtttgcaggagtatcaaagctggctgtcggagcaaaattacaaaccgacctcgaaagcgcgcatgttgtcggcgattcgtcgcctgtttcaatatctgcatcgggaaaaggtgcgcgctgatgatccgagtgcgctgttggtgagcccgaaactgccaacgcgcttaccaaaagatttgagcgaagcgcaagttgaagctttgctgagtgcgccagatccgcaaagtccacttgagctgcgtgataaagccatgctggaattgctgtatgctacgggactgcgtgtgacagagctggtctcactgaccatggaaaacatgagcttgcgccaaggtgtggtgcgagtcatgggtaagggtggtaaagagcgtttggtgcctatgggtgaaaatgccattgaatggattgaaacttttttgcagcagggacggtctttactgctaggggagcagacgtcggatatcgttttccccagtagccgcggtcagcagatgacccggcaaaccttctggcatcgcattaaacactatgcggttattgcaggaattgatgtggaaaaactctcgccgcacgtattgcgccatgcgtttgccactcacttgctcaattatggggccgatctgcgcgtagtgcagatgttgcttgggcatagtgatttatcgaccacacaaatttatactcatgtcgccactgagcggcttaaacaactccacaacgagcaccatccaagggcttgaaaataaggtgattttcatgagcgtactgcgccgactaacatggctggcatttcctttactgagtatggcattcaacgtacaagcgaacactgcaccagcacaattgaataaagccgagcttgagcagcgctttgccaaactcggattgcaagtggaagagataaaaacctctgatatcaatggcttgcttgaagtgcaaacgtctggtggtgtgttgttctcttcgcctgatggtgagcactttatcgcgggtactctgtatgcgctggatggtaatggcggttatgttgatgtgctggctaaacgccaagcgccactcaacgccaagaaaattgccgcattgcaagacagcatgattgagtttaaagcgcccaatgagaaatacgcgatcaccgtatttaccgatatcacgtgtggttactgtgtgcgtctgcacagccagatcaaagagtacaatgatctcggcattacggtgcgttatctcgcctacccgcgtcaggggccgcaaggtcaagtcgcggatcaaatggcggccatctggtgttctaacgatccgaaagcggcgatgcacgatgcgaaagtgaatcgtaaaaccattaccgccgataaagatatcgcccaatgccaaaagaccatcgcgcagcactatatgctgggtcacgagctcggcattagcggtactccagcgattttcttacccaatggtgagatggttggcggctatttgcctgcgccgcaattgctgcaacgcctgcaagccacacaatagtttttcattttcgactaattaaggaaacaggccagaggcaactttggcctgtcacagtatgatagaaatccagcgacgccccgaacctgatctctcacttctccccgaccacatcgacccactgttacgtcggctttacctgagccgtggtgtaagcaacgtggcacaacttgaaaaagccgccaaagcgctgcactcattcaagcagttacatggtattgatcgtgcggttgagttgctgttcgcagcgattgctgagcaaaaacgcatcatagtcgtcggtgattttgatgccgatggcgcaaccagttcggcactttccgtgctcgcgctgcgtatgctcggtagtcgtaatgtcgattacttagtgccaaaccgttttgaagatggttatggtctgagccctgaagtggttgatcaagcgattgagcgtggcgcagagatgatcatgaccgtggataacggcgtttcatcactggaaggggtgcgttacgccaaacagaaagggctgcaagtggtggtcaccgatcatcacttaccgggacaagaactccctgaagtcgatgccatggtaaacccgaacttgcagcagtgtgcttttccttctaaggcgctggctggggtgggggttgctttctatttgatgatggcactttgtgtgcacatgcgtcagcaaggttggtttgccgcgcaaggcatggttgaaccgaaattgatggaactgatcgatttagtggcactcggtacggtcgccgatgtggtgccactggatgacaacaatcgtattttggtgcaccaaggtttgcagcgtattcgtgcgggtttagcgcgccccggtattcaagctctgattgaagtcgccaaacgggatgcgcgccgtttggtcgctgctgattttggctttgcgcttggaccacggattaacgccgcagggcgtttggatgatatgtcgttcggcgttgaacttttgctgtgtaacaacattcacgctgcgcggcgtatggcgagtgagctggacggcctcaatcaaacccgaaaagagattgaagaggggatgaagcaagaggcggtcgcgttttgtgagcgtttgcaactgagcgatgatcgcgagctgccttacggtttagtgctgtttcagcgcgattggcaccaaggggtgatcggcattcttgcttcgcgcatcaaagagaaataccaccgacccgtgattgcgtttgctgaaggtggtgatggcaagctaaaaggttcatgtcgctcggttcccggtctgcatatgcgtgatgcactagataaaattgatacgcaaaacccgggcatcatactcaaatttggtggtcacgcgatggcggctggattaaccattgaagagcaaaattttgaacgtttttgccgactgtttgaccagctagtgcgtgaagagctggatgaagcagcactcaaaggcatcatcctcagcgatggcgaactgaaaccggaagagttttcgctgcataccgccgaattactgcgtgctggtggcccgtgggggcaagcgtttcctgaacccctgtttgatggcgaatttaaagtgctgcaccaaaaactggtcggcgaaaaacacctcaaactgatgcttgagccgctatataaaggctttccaaccaatgtgatgatcgacggaattgcgtttaatgtcgacctacgtcgctggccggatgcctcagtcaaaacggtacgtttggcgtacaaactcgacatcaacgagtttcgcggtaatcaatcattgcaactcatgattgatcatctggaagcgaaatgattgaaaacaacgccctctctcataaaaagagggcgttttcgttattaaggattaagtgcttccaacaaaatcagttcacgttttagcgtggttttttcattctctggcgcactttctaggcgcgataggcgctgcgtaatcgccgcgtttttcgcttctgagtttttcaaaatcaggtcttggacattaattgattcaatattggtgtaacggccatcagcgctggcagggacatccatttttccactattaatcagctctttaacgatctcccgttccttctcaaatccttctaaaccagacagtttccagcgttgcatcggtttaccttcatacttaccttgcttttgttcggtgaggtatcgaatggtgaggttgcgaatcgtgccttgttcttcaccgtattcggcttcggtgtcaaacagcactgggaattgttgtccttccagtatgccgcctttcttagtgagatgccccatacggtagctattcatgcctagacgaatttcactgttgtcctttactggtgtgccatctgcaaattttaagtcggtaatacgttcacctgctggctgagtcagatcgatggtgtaagtgactcccgcaaaaaaatcgttagtggagtattttgatgcacgacgttcagggttaaagctgtaagtgacgtcaccgggcttgacggagttgaagtagcctgccgaccattccatatattgtttcaactctttgcctgtcattcggtaaaccgtaatttcaccgccagcatattggtagttgtaggcgatgtctttggctttgatcgagccaacgtctaacttggcattgtcgttatcaatttgcagcgcaatcacattggctttgggcgcatagaaaaagctggcttcttggaatagagcactgatgcctgtgtcttgcacatgcacttgtgggatgccacgaatttcgttttctggcaccaagttcaccccactcagttgggcaatttcgcggttcgccatttcacgtaagcgtttatggtaaggctcgtagagcgactccattttgctgtcagaggtaatgtctttgattttgtaggtcagactatctttattgatgagagtgaacttgccattttgctcttcaaattgcaggtcgatacgcgatagcgcacggccgtatttatcaggctcggtgatgatcacgccattcaccacggctttatcaatcagcgtatgcatgtgacctgctacaatcgcatcgagctcagggttgccgttagctatgtcagtaacaccggtattggtgatgtcgttttcattctcaatccccatgtgtgccactaatacaatcgcatccacctgcggatcaatttgtttgatgatcttttgcacttcgagagttggattagtgaaggtcatgccttcgagccgatttgtcccttcagcaaacacttgggtcattggagtatccataccgatcaccccaatcttgatgccaccacgttcaataatggtgtaaccgggtaggaaaggattaccatcaggacgttggatgttacccgctagagagcgccctttaaattgagttaaggagcgattaaggactttgagaccaaagtcgaactcatgattaccgagtacccaaacgtcgtacttcatttcgttgaagcctagcatcatcggatcaatcgcttcatctttgaaggtttcaacaaagttgccctgaatggtgtcgcccgcatcaaccaaaattacgttaggttgctcttggcggatggttttcaccttggtggcaatttggctcaagctgccacttagattgagtttatccgcagagtaatcccaaggcatgaaatggccgtgcagatctgaagtacccaaaatggtgacattatggatatctccattggcggccaaggccggaaaagcaaaggagagcgcgatagcgctggttaagattgtttttttcattgtcagtcacgttataagttaaaaccccatgcatactaactaattgaataataactaaatgtgattggtgttgataaaacaatgaaatagccaaatagtttgcattgagttgtgagatttgagcaactttatagcgacgaagatgatcctacgtcctccttctcaactggatttagcgcctcgctaaaaaatcagaaatatttatcttgctaaaaaatcttcatttttcttcaaaatcagcggtgtactgacacctctagcccatcaagtccccatctgtatatgagttgtaattggtctgaccaatatttttgctgttttaatcaactattgttgctggattgttagagcgtgagcggttctatgatttaggtcaattttcggctggacactggcgttttaattatgttaatttctgcaccaacttaaaattggtattaccaattgccagcaagaagaataagagtagaagaacaataaattatggcttatcaaaggatccgtcagccaaagctctccgatgtgattgaacaagaactggagagactgatagtggaaggaacactctcacccggtcagcaacttcctccggaacgcgaactggccaaacagtttgaagtgtctcgcccctcgatcagagaagccatacaacgcttggaagccaaacgcttgcttacccgccgtcaaggtggcggtacattcgttagtgaccgaatttggcagagcttttctgatcctctgctaaatttattgtctagccactccgaaactcaactggatctgctggaagcgcgtcatgcgctggaaggtatttgcgcctattttgcggcgttgcgtggtaccgaagaagattttgctcgtattcagcactgtgtcacgcgtatcgcggaggctcaggcattgaataatgtggatgaagaagcagagcgggtgatggcctttttgattgccattactgaagcggcgcacaacgttgtgcttctgcacatcgtacgcagcttgagtccactgcttgagcagaatattcgtcagaattttaaactcttacatcgccgccctgaagcggtagagaaagtaagcaaacaccgggctaacattgtggatgcgatcgtttcgggtcagccggaaaaggcacgtgaaatgtcccattctcacttagcttatatcgaagaaacgttgttggatttgactcgtgaacagactcgccgtgagcgatctctgcgtcgaattcaacaaggtaatgagccgcaatagcggccattgcgattcaacttaaatccaaccaacagaaggatagatcgccatgtctgacatgaagcatgacgtagatgcactggaaactcaggagtggcttgctgcccttgaatccgttgtccgtgaagaaggcgtagagcgtgcgcagtacctgcttgaacaagtactggaaaaagcgcgtttggatggggtagacatgccaacaggcgtgaccaccaactacatcaacacgattcctgcggcgcaggagcctgcttacccgggtgacaccacgatcgaacgtcgtatccgttcaatcattcgctggaacgcgatcatgatcgtgctgcgtgcatcgaagaaagatctggaactgggtggccacatggcttctttccaatcttccgctgctttctacgaaacctgtttcaaccacttcttccgtgctccaaacgagaaagacggtggcgacttggtttactatcaaggtcacatctctccagggatctacgcgcgtgctttcgttgaaggccgtttgaccgaagagcaactggacaacttccgtcaggaagtggatggcaaaggtcttccttcttacccacacccgaaattgatgcctgaattctggcaattcccaaccgtatctatgggtctgggtccaatttctgcgatttatcaagctcgtttcctgaagtatctgaatggtcgtggcctgaaagacaccacggcacagcgcgtatacgccttccttggtgacggtgagatggacgagccagaatcacgcggcgcgatctcttttgctgcgcgtgagaagctggataacctatgcttcctgatcaactgtaacctgcaacgtctggacggccctgttatgggtaacggtaagatcatccaagaactggaaggtctgttccgtggcgcaggctggaacgttgtgaaagtgatctggggtaatggctgggacaaactactggcgaaagataccacaggtaaactgctgcaactgatgaacgaaaccatcgacggcgactaccaaacgttcaaagcgaaagatggcgcttacgttcgtgagcacttcttcggtaagtacccagagactgcagcactggttgctgacatgactgacgatgagatcttcgctctgaaacgcggtggtcacgaatcatctaaactgtacgcggcgttcaagaacgctcaagacaccaaaggtcgtccaaccgttatcctagcgaaaaccgttaaaggttacggcatgggtgatgcggcagaaggtaagaacattgcgcaccaagtgaagaagatggatatgacccatgttctggcgatgcgtaaccgtctaggcctgcaagatctgatctctgatgaagaagtgaagaacctgccgtacctgaaactggaagaaggctcaaaagagtttgaatacctgcacgctcgtcgtaaagcactgcatggttacacacctcagcgtctgcctaacttcactggcgaattcatcgtgcctgcattggaagacttcaagccactgctggaagagcaaagccgtgaaatttcttcaactatggcgtatgtacgttcactgaacatcctgctgaaagataagaacattggtcaaaacatcgttcctatcatcgcggatgaagcacgtacgttcggtatggaaggtctgttccgtcaaatcggtatctacaacccgcacggtcagaactacactccacaagatcgcgatatcgtttcttactacaaagaagcgacttcaggtcaggtactgcaagaaggtatcaacgagctgggtgccatgtcatcttgggttgcggcggcaacgtcatacagcaccaacaacctgccgatgatcccgttctacatctactactctatgttcggtttccaacgtgttggcgacatggcgtggatggcgggtgaccaacaagcgcgtggcttcctactgggtgctactgcgggtcgtacaacgctgaacggtgaaggtctacagcacgaagatggtcactcgcacattctggcgggcacagtaccaaactgtatctcttacgatccaaccttcgcttacgaagttgcggtaatcctgcaagacggtatccgtcgcatgtacggtgagcaagagaacgtgttctactacctgacactgatgaacgaaagctacgctcacccagcaatgcctgctggcgctgaagaaggtatccgtaaaggtatctacaagctagaaacgcacgctggtaacaaagcaaaagttcaactgatgagctcaggcactatcatgaacgaagtgcgtaaagcggcacaaattctgagtgaagagtacggcgtagcgtctgacgtttactctgtgacttcattcaacgagctggcgcgtgatggccaagcgtgtgatcgtttcaacatgctgcacccagaagcagaggtgaaagtaccttacatcgcacaagtgatgggtactgagcctgctatcgcagcgactgactacatgaagaactacgcggatcaagtacgtgcgttcattcctgcacagtcttacaaagtgctgggtacggatggtttcggccgctcagacagccgtgaaaacctacgtcgtcactttgaagtgaatgctggctacgtggtagttgcagcgctgaatgaactggcaaaacgtggtgaagttgagaagtctgtggttgcagcagcaatcaagaaattcgacatcgatactgaaaaaaccaacccgctgtacgcttaattgaaggtaggaaaagtaatggcaatcgaaatttatgtacctgacatcggtgcggatgaggttgaagtcactgagattctcgtcaaagtcggcgacaaagtggctgaagagcaatctctgatcacggttgaaggcgacaaagcttctatggaagttcctgcgtctcaagcgggtatcgttaaagagatcaaagtagtggcaggtgacaaagtgtctactggctctctgatcatggtctttgaagcggaaggtgcagcagcggcagcaccagctcctgcgcctcaagcggcagcaccagttgctgcggctccagcggcagctgcactgaaagaagtgcaagtaccagacattggcggtgatgaagttgaagtgactgaaatcatggtcaaagtgggcgatgtggttgcggaagagcaatctctgatcaccgttgaaggcgacaaagcgtcaatggaagtacctgcacctttcgctggtacggttaaagagatcaaaatcgctgcgggcgacaaagtatcaacaggttcactgatcatggtgtttgaagtagccggcgctgcgccacttgcagcacccgttcaagctgcggcaccagcggcagctgctgctccggccgttgcagcactgaaagaagttcaagtacctgatatcggcggtgacgaagtgaccgtaacggaaatcatggttaacgtgggcgacagcatcagcgaagagcaatctctgatcaccgtagaaggcgataaagcttctatggaagtacctgcaccttttgccggaactctgaaagagatcaaagtggctacaggcgataaagtgaaaacaggttcgctgatcatggtgtttgaagttgctggcgcagcgccagtcgcggcaccagttcaagcagcagcagcacctgcggcagcgcctgctcaagcagcgactcctgcggcggctgcacctgcaacaagtggtgaattccaagaaaaccatgagtactcacatgcttctccagtcgtgcgtcgtctggctcgtgaatttggcgttaacctagccaaagtcaaaggctctggccgtaagaaccgtatcctgaaagaagacgtacagaactacgtgaaagaagcgctgaaacgtctggaatctggcgcgcaagcggcggcttcaggtaaaggtgatggcgcagcgctgggcttactgccttggccaaaagtggacttcagcaagttcggtgataccgaagtgcaaccactgtctcgcatcaagaaaatctcgggtgctaacctgcaccgtaactgggtgatgatcccgcacgtgacccaatgggacaatgcagacatcactgagctagagaaattccgtcaagagcaaaacgcgatggaagcgaagcgcgacacaggtatgaagatcactccgctggtgttcatcatgaaagccgctgcgaaagcgctggaagctttccctgcgttcaactcttctctgtctgacgacggcgaaagcttgatcctgaagaaatacgtgaacatcggtatcgcagtggatacaccaaatggtctggtggttcctgtgtttaaagatgtgaacaagaaaggtatctacgagctgtcaaaagagctggctgaagtctcgaagaaagcccgtggcggtaagctgactgccgctgacatgcaaggtggctgtttcactatctctagcctaggtggcattggcggtacagcgtttaccccaatcgttaacgcacctgaagtggctattttgggtgtgtctaagtctgagatgaagccagtgtggaacggcaaagagttcgcgccacgtctgcaactgccactgtcactgtcttacgatcaccgcgtgatcgacggtgcagaaggtgcacgcttcattacttacctgaacgagtgtctaagcgacatccgtcgtctggtactgtaagcgcattctcgggtggcgaaagccacccgatttaatggttatctcccaatttgacgttgaaactgattttccgttgaattgttgtctagctcacaggctacatggatttacttttcacaccattaacatctctgtaaactgttgcggtctgaaagtaatcgttttacatgcttgatttgaaacattcgtttttgattcgtttgtaaataaaacaactagatagaacacccatcagcctgttagggatattgactacaagaggtcgaaatgagcaaagaaattaaagcccaagtcgtggtgcttggtgccggtcctgctggttactccgccgcattccgctgtgcagacttaggtctggataccgtcatcatcgaacgttacaacacgctaggtggtgtgtgtctgaacgttggttgtattccttctaaagcactgctgcacgttgcaaaagtgattgaagaagctaaagcgctgactgagcacggtatcgtgtttggcgagccaaaaacagacatcgacaaagttcgtctgtggaaagaaaaagtgatcaatcagctgaccggtggtctggctggtatggcaaaaatgcgtaaagtgaacgtagtgaacggctacggtaaattcactggcccgaacaccattgaagtggacggtgaagagggcaaaactgtcgtaactttcgataacgcgatcgttgcagccggttctcgtccaatcaaactgccattcattccgcatgaagacccacgtatttgggattcaaccgatgcgctggaactgaaagaagtgcctggaaaactgcttatcatgggcggtggtatcatcggtctggaaatggcgaccgtttaccactcactgggttctaaaattgatgtggttgagatgtttgaccaacttatccctgctgcggataaagatatggttaaagtctataccaaacgcatcaaagataagttcaacctgatgctggaaaccaaagtgaccgccgttgaagcgaaagaagatggtatctacgtttcaatggaaggtaagagcgcaccagcacaagctgagcgttacgatgcggttctggttgcgattggccgtgtaccaaacggtaaactgctggatgctgagaaagcgggtctggaagtggacgagcgtggctttatccgtgtggataagcaaatgcgcactaatgttccgcacatcttcgcgatcggcgacatcgtgggtcaaccaatgttggcacacaaaggcgtgcatgaaggccacgtagcggcagaagtgatctctggtaagaagcactacttcgatccaaaagtgatcccatctatcgcttacactgagccagaagtggcttgggttggtaagacagaaaaagaagcgaaagcagaaggcatcaactatgaagtggcgactttcccatgggcagcttctggccgtgcgattgcttctgactgtgcagacggtatgactaagcttatcttcgataaagagactcaccgcgtgatcggtggtgctatcgtaggtactaacggtggtgaattgctgggtgaaatcggtctggcgatcgagatgggctgtgatgcagaagacatcgcactgaccattcatgctcacccaacgctgcatgagtctgtgggtctggcggctgaagtattcgaaggcaccatcactgacctgccaaacgccaaagcgaaaaagaaaaagtaatttctgattcactggtttggttaaaaagtgtttgattgaagaaaccgctgcttgcagcggttttttttcgcttttgattcccaattgaatgcaaagtaagcagttaaaccgagatttaacgcgctggcggattgtttctggactctgctcacacttctcgctacaatccgccgcggagttgactgggtagtcgctgccttattgacgtcccttggcctatcgccagggagactgataagggggaggaaagtccgggctccatagagcagggtgccaggtaacgcctggggggcgcaagcctacgacaagtgcaacagagagcaaaccgccgatggcctctccttcgggatgggatcaggtaagggtgaaagggtgcggtaagagcgcaccgtgcgactggcaacagttcgtagcagggtaaactccacccggagcaagaccaaataggcctccacatagcgttgctcgcgttaggaggcgggtaggttgcttgagccagtgagtgattgctggcctagaggaatggctactaccgcgcaagcggaacagaacccggcttatacgtcgactccacctattgcagacccatcatagccttgtgttatggtgggttttttgctttttgctgactcaggtaacagcaaaaccattaaacttagcgcaaagtcacgtcctgtatacgcttatggctagcggtagtgtctgaaatcggtacactaacccatatgacgggcatgcccagcacaacgagaaaatcatgactgcttctttccaacacatctctgtattattgaacgaatcgattgaaggattggcgatcaagccggatggtatctacatcgatggcacctttggccgcggtggtcacagtcgcaccattctcgctcagttaggcccagaaggtcgtctgtacagcattgaccgtgatccacaagcgattgctgaagcgcagaagattgatgatccgcgttttaccatcgtccatggccctttctcgggcattgccgaatacgcacagcgttatgatctggtgggtaaagtcgatggtgtgttgttcgatctcggcgtttcttcaccgcagttggatgatgccgagcgcggttttagttttatgaaagatggtccactcgacatgcgtatggatccaaccagtggtatgccagtttccgcgtggttggcacaagccgacttggatgacatcacttgggtgattcgcgagtttggtgaagataaacatgcgcgcagaattgccaaagccattgtcgaatatcgggaaaacgagcttaacgagcccttgacgcgtaccagccagttagcaaaactcatctccgatgcagcacctaagagttttaaagagaaaaagcaccctgccacccgcgcttttcaggcttttcggatctatatcaacagtgaattagaagagattgataccgcattgcgcggcgcttctgacattctggctccacaaggccgtttgtctgtgatcagtttccattcactggaagatcgcatggtgaaacgctttatgcgtaaagagagccaaggcccgcaagtgccgcacggtattccgttgacccaagatcaaattcgcgcgttgggtagtgccaaaatgaaaaccgtgggtaaggcactcaagccatcggatcaagaagtcgaacttaacccgcgttcacgcagctctgttctgcgcgtggcagaaaaactgtagagggttactatgcctcgtcagtcgccgccgaacctcgcgaagttaattgccctcgatctactgacggtaggtcgggtgcccttgctgcttttagtgctgatttttagctgcgctatgggcgtggtgtttatgactcaccatactagacaggcgatcagtgctaaagatcaagcctttatggagcgtgagcggctcgataacgaatggcgcaacctgattttggaagaaactgctttggctgagcacagccgagtacaacaattagcaagaaaagatctggagatgaaacgtccagattcagacaaagaagtcgtgatcaaccttaaatgaagaagaaagccccagccaaagcctcccgagtttctccccgtgttaccacggctgagcctgcacctatctttatccgctggcgtttctatctgctgctgttttttgtgctaacggcgttctgcgctttggttgcacgagtggcttatatccaaattattgaacctgacaatctgattaaagaaggggatttgcgctcgattcgcgccaaaaccttgcaatcagcgcgcggcattatttccgatcgtaatggcgaagcgttagcggtgagtgtgccagtcgaagcggtctgggccgatcctgtcgctatttataaagaaggcggtctggttgagaaagaccgttggtatgcgctggccgatgtgctcggactggatcgtcaggagatgatgaagaaaatcgaggataaccgttcgcgccgctttatctatctgcaacgtcaggttagccctgcgatggccaaatacatccgtgaactcaaattagcggggattggcctaaaagaagagtcacgccgctattatcccgcaggtgaggtgagtgcccacttagtcggggtgaccggaattgatggccacggtcttgaaggggtagagcgcagctttgatagcaccttaacgggtgagtcaggtaaaagcgtgacgcgtaaagataagttcgggcgagtggtggaaaacattgccctggaagagcgtgaagaaggtaagcctatccagctcaccattgaccagcgcttacaagcgatcgcttttcgtgccgtgaaacaggcgatggcggattatcgtgcgacttctgcatcggcagtgatgttggatgtgaaaaccggcgcggtactggcgatggtgaatgcgccttcttacaacccgaataatcgcaatgactggcaaagctttaaaatgcgtaaccgagtgataaccgatgcgtttgaacccggttcaacggttaagccttttgtggtcttggcggcgctcgccaatggtatcgccgacaaaaacaccatcatagataccggagatggcaccatgcagattggcggtagccgcgtgcgtgatacctccaaagttggcaaagccgatctcacgctgattttgaaaaagtcgagcaacattggtgtggctaaattagccttagaaatgccgttagaggcgttattgggcatgtatagctcggtgggcttgggcgaaatgtctggcttggatttggtgggcgaaacgatcggtattttcccgaatcgccgccgttggtcacagtttgaaatcgccaccttatcgtttggctatggtttggcgatcacgcctattcagttggctcacgcctacgcgaccttaggcaatcatggtaaataccaacctattcatattattaaaggtgatcaacatggcgagacgcgccaagtggttgatcctaaatatgtcaatcaggtgctcgaaatgctggaaacggtaactcagcccggcggaacggcaacgcatgcagcggtaccggggtatcgtattgcggccaaatccggtacgtcacgtaaagcgattgcgggcggttatagtgatgaatattttgcctacaccgcaggggtggctccggtgagcgacccaagaatttcactggtggtcatggtcaatgagccgcaaggcgactcttactatggcggcgcagtggccggtccggttttctcggaaatcatgaagggcgcattacaaatcctcaacattgctcctgatgaaaaccgcttccaaaacaaataatagtgtgagacggaacatgaacacgcattcagcgatctccgaactgatcgcgccatggctagagctgaccgaccctaagttggccgcgctggtcattactcatcttgaactggatagccgcctgattaaatcgggtgatacctttgtggctattcaaggccatgcagtggatggtcgccaatttatcgataaagccattgcgcaaggtgccaatcttgtgttggcagaagccgatgctcagcatctcaatgggtgggttgagtatcgtgctggtgtccccgtcatctatttggctgaacttggtcaacatctgtcagagttggctgggcgtctgtatggcggccaccacaatcaactgattggcgtgacgggcacgaacggtaaaaccaccatcacccagctgattgctcaatggctcgaattgctcggtcataaagctgccgtgatgggcaccacggggaacggttttttaaatgcgcttgaacctgcggccaacaccacaggtaacgcactgcaaattcaggccacactgcgcgatttagccgagcgcggcgcgcaatatacggcgctggaaacctcgtctcatggtttagtgcaagggcgcgtgaaaaagctccattttgtggccggtgtcttttccaatttgagccgtgaccatttggattatcacggcactatggaggcttacgccgccgcgaaattctctctatttagtgagcatgcctgccaaaacgcgattattaatgtcgatgatgcggtcggcgcgcaatgggtcaaacaattgccgcaggcgatcggggtttccttagtgacgaaaccaaacacagcgcaagccatctgggcgcgcgaagtggcatacgctgaaagcggtattacgctgaactttgagagttcgtggggagaaggcgaattgcacgcaccactgattggtgagttcaatgcctgtaacttgttattggcattggcaaccttgctcagcttgggttttgagaaaagtgcactgctcgccactgcgccaaagctgcgtccagtcttaggacggatggagctattccaacgtgagcaaaaagccaaaatggtggtcgattatgcgcacacgccggacgctttagaaaaagcactgcgcgcgttacgtgtacattgtgcgggtcagttgtgggctattgtggggtgtggcggcgatcgtgatcgcggtaaacgtccgatgatggctgcgattgctgagcagtttgccgatcgcgtgatcttgaccgatgacaacccacgcagtgagtcgccgcaagcgattgtagcggatatggttgcaggactgacttaccccgagcgcgctcatatcgaacaccaccgtttccaagccgcgagttatgcgcttcagcatgcaggtgcgcaagacatcatcctgctcgcgggtaaaggacatgaagattatcaggtgctggccaacgaaacgattcactactcggatcgtgaaaccgcccaacagttactggagttacaaccatgattcgcgtaatgctttctcagctcagctcagtattgaatgctcgtttaattggtgaggatcgcgcggtcagtgccgtatcgacggacagtcgtgctattcccgccgaagcgctgtttgttgccttggtcggtgaacgttttgatgcgcacgattttgcctctcaagcggtaactggtggcgcagtggcgctgttggttgagcgtgagctcgatgcagagtgttcacaactggttgttgccgataccaaacaggccttaggtcagcttggctcttgggtgcatgcgcagtgtcaaacgcctacggtcgcgatcaccggaagttgtggcaaaaccacggtcaaagagatggtggccagcattttaagccagaaaggccaagtgctttacacgcaaggaaacttcaataacgacatcggcgttccgctgactctgctgcgctcaacgaccgaagatgattatgccgtgattgaattaggggcgaatcatgtaggtgaaattgcctacaccaccgccttggttaagccggatgttgccctagtcaacaatgtagcggcagcgcacttagaaggttttggctcgatggatggcgttaaacgcgctaaaggtgaaatctatcaagggttacaggcgggtgccgtggcgattgttaatttagacagcaacggtggtgactactggaaagcggtactggcggacaaaaccgtgaaaacattttccgctaccgatcacaatgctgacttttatccacgtgatgtgcggttaaatgcgctcggtatagctagctttactttggttaccccggttggtgaagtgggtgttgagttgggcatcatgggccaacacaacgtggccaatgcactggctgcggcggcgttatcactggaaatgggcgcgagcttggcggaaattggtcaaggtttagcgcatttatccaaagtgaaaggtcgagtggatatggcacagttgcgtgacgatatcacgcttattgatgacagctataacgctagcgtgccagccatgaaagcggcggtggagctgttaggcagcttttccgctgtacgctggttaattttgggcaatatggcggagttgggtgatgaaagtcttgcacttcatcagcaagtcggtgaacatgctgcaccattcggttttgagtttgtcctgacgtatggcaaggacgcaaaagtgatcagcgacctttgccaagggcatcactttgctacccatcaggacatgatgacatttattgagcagcacatagaacaacaacagggtcgtactcaagtattgttggtgaaaggtgccaacagtgcagggatgagtaaaattgccgctgctctcaaggagaaatttgcatgattatttggcttgctgaactgctccagccatatttttcgtttttccgtctgttcgaatatctctcatttcgcgccattgtcagcattctgactgcgcttgggatctcgttgtggatggggccgcgcatgattaagcgcctacaaatgctgcagattgggcaagtagtgcgtaatgaagggcctgaatctcacttcagtaaacgcggtactccgaccatgggtggggtgatgatccttgccgcgatcaccatcactgtactgctgtgggccgatctgactaacccttatgtttgggctgtgcttgcggtactgctcggttacggtgcggtcggttttgtcgatgattaccgtaaagtggtgcgcaaaaataccgatggcttgatcgcgcgctggaaatacttctggcaatctgcgattgctttagtggttgcgtttgctctgtatgcgcacggccaagatacggcggcaacgcagttggtggtccctttctttaaagatgtgatgccacagctgggcttgatgtacattgtgctgacctatttcgtgattgttggtaccagtaatgcggtgaacttgaccgatggtctggatggcttggcgatcatgccaaccgtattggttgcagccggatttgcggcgattgcatgggcgaccggtaacgttaacttcgcgaactatctgcatatcccttatattcctcactcttctgagttggtggtggtgtgtaccgcgatggttggtgcaggtttaggctttttatggtttaacacctatccagcccaagtatttatgggcgatgtcggcgcgttggcgttaggtggcgcgttaggtacgattgcggtactggttcgccaagagtttgtgttggtgatcatgggcggtgtattcgtgatggaaaccctgtcagtgattttgcaagttggttcttacaagctgcgtggacaacgtatcttccgtatggcaccgattcaccatcactacgaattaaaaggctggccagaaccacgtgtgatcgtgcgtttttggatcatctctatcgttttagtattgattggcttagcgacactcaaagttcgttaagtggattaaggatgtcaatttcaatggaccgttggcaaggcatacaacatgtggtcgtcgtagggctcgggattaccgggctctctgtcgttaattatctgagaaaatatcatccgtcggtaaccgtgcaggttatcgatacgcgcgaagcaccaccggggcaagagcagctttcgtcggacgttgcactgcatcgtagcggttggaatcttgagtggttactcaatgccgatttggtagtcaccaacccaggcattgcgttggcgacgccggaaatccaacaagtgctggccgctggaattcctgttgtcggtgatattgagctctttgcatggcatgtggatacacccgttattgcgatcactggctcaaatggcaaaagcaccgtcactgatttaagcggtgtgttagccaatgctgctggtgtgaaggccgcggtaggtggcaatattggggttccggcactggatctgatttctccagacgttgaactgtatgtgcttgagctatcaagcttccaattagaaactacctctagcttaaaactgaaagcggccgcgtttctcaatctttctgaagatcatatggatcgttatcaggggatggaagattaccgccaagccaaactgcgcattttcgatcatgccgaaaccgcagtggtgaatgccgatgatactcaaacttttcctgaccacgcggcacatctgcaagtggtgacgtttggtgtcgagcaagctgcacaatttagccttgctcaacatcaaggccgcgaatacctttttgcgcgcgatgaggccgtcatggcgtgtgctgagctgagtttagttggccgtcataacgtggcaaacgtacttaccgtgttagctttgctggattcagccggagtaaacttccgtttggctttggatgcactcaagtcttacacaggtttgacacaccgctgccaagtggttgccgataatcacggcatcaagtgggtcaatgattctaaagcgaccaatgttgcgagtacgctggcagcattgtcgggattaaaaatcgaaggtcagctctatttgttggttggtggcgtaggtaaaggggcggatttcacgccgctcgcccccgtattggcgacattgcctgtgcaattgtgctgctttggtgtggacggccatcaatttatgccactgcacccttcggctcggttttatgactcgatggagagcataattcgctcaatccgcccgcaattaaaaagtggggatatggtgctgctctctcccgcttgtgcgagctttgatcagttcaaaaactttatggcgcgtggggatatttttgcccaactcgctcggcaatatgcataagctttaggtaagtcacttgtttttatccggatctttcacaaaactgagccactggttgagaacctcctcaccagaggcgctgtttgaccgtcaattggtctggattgcttttggcttaatgctgattggtctggtgatggtgacatcagcctcatttcccatcagttctcgcctaaccgatcaaccgtttcactttatgtttcgtcacgccatctttctactgttggcttttctcacctcaagcatggtgttacaagtccctctagatcgttggatgaaatacagctcgttactactcggcatctcctttttcttattgattgtcgtactggtcgtgggcaaatcggtcaacggtgcatcacgttggatcccgctcggtctttttaaccttcagccagcggaagtggctaagctgtcactgtttatctttatgtccggctatctggtgcgcaagcatgatgaagtacgacagactttctttggcggctttttaaaacctatcatggtgtttggtacgctcgctgtgttgctgctcggtcagccggacttaggtaccgtgatcgtaatgctggtgacactgttcggcatgctgtttattgccggcgcgaaactctctcagtttttggccttgatggtggcaggagtgttagcggtggtcgcgctgattgtcgctgaaccttatcgtgtacgccgtgtgacctcgtttttagatccatgggaagatccctttggtagcggttaccagctgactcaatctttgatggcgtttggccgcggtgagtggtttgggcaaggattaggcaattcgattcaaaaactcgaatatttgcctgaagcgcatactgactttgtattcgccgtcttggccgaagagcttggctttatcggcgtggtattagtgctggtgctgattttcagtttggtactaaaagcgatttttatcggcaaaaaagcctttcaacatgatcagcagtttggcggctacctcgcgtttggcatcggtatttggtttgcgtttcagaccttagtgaacgtcggtgcggcagcgggtatggtgcccaccaaaggcttgaccttaccgctgatcagttacggtggttccagtttaattattatgtcagtggcggtgtcgattttactgcgcatcgatcatgaatgccgtttagcggatcgccacgcaccagaagaaatcacagttgatgaacaagaataaaaaattaatggtgatggccggaggaaccggcggtcacgtatttcccggtttggctgtcgccaaacaactacagcaacagggttggcaaattcgttggttgggaacggctgaccgaatggaagcggaattggttcctaagcacggcattgagattgactttattcaagtcaaagggctgcgcggccaagggctgatgcgcttactcaaagcacctttccaaattgtgaacgcgattttgcaagcgcgccgccatttgctgacttatcagccagatgcagtactcggcatgggcggttatgtgagcggacccggcgggattgccgcttggttactggggattccagtggtgttgcatgagcaaaatgcggttgctgggctgactaaccaatggctggctaaaattgcacggcgtgtatttcaagccttccccggagcatttgctgacgcgtctgtggtgggtaacccagtacgtcaagatgtggtacaacttgccgcgccagagcagcgttttgccacgcgtaacggcgccattcgaattttagtcatgggtggcagccaaggtgcccgcatcctaaaccaaaccttgccagcggtgatggcggcattaggtgagggttatgaaatccgtcatcaagccggtaaaaacagccaacaagacgtggctgaggcttatgctgctgccggagtggaaagcgcgcaagtcaccgaatttattgatgatgtggcagatgcatacgcttgggcggatctgcttatctgtcgctcaggcgcattgaccgtctcagaggtctcagcggcgggcgttggggcgatttttatccctttcatgcataaagatcgccagcaagcactcaacgctgatcatttagtggcttgtggagccgccaaaatgattgagcagcccgaattgagtgtggaaaagctgacccagatggtgcgcgaactcgatagagcacaattattgtccatggctcagaaggcgcgccaagccgccaaattagatgctgacaaggtggtggcgcaagcgatcatcgccattaccgaataacgagaacagaattatgacgattaaacatacccaagacctcgcccaaattcgcgctatggtgccagagatgcgccgtgtaaaagcgatccactttattggcattggcggggcggggatgagcgggattgcggaagtgctgctcaatgaaggctatcaaatttcaggctccgatctggccgcgaatgcggtcactgaccgtttagctgacaaaggcgcgaccatttttattggtcatgaagcgcacaatgttgctcacgcaagcgtggtcgtggtctcgacggctattaatgaacaaaaccctgaaatccaagcggcgcgtgaaaaacgcatcccgattgttcgtcgtgctgagatgttggcagagctgatgcgttttcgccacggtattgcggtcgcgggaactcacggtaaaaccacgacgacggcactcgtcactcagatttattctgaagccggactggatccgacctttgtgaatggtggtttggtgaaaagcgctggcaccaacgcacgtttgggctctagccgcattttgatcgccgaagcggatgaaagtgatgcttcattcttgcatctgcaaccgatggtcaccattgtcaccaatatcgaagccgatcatatggatacttacggcggcgattttgaaaaccttaaacagacctttatcgactttttgcacaatctgcctttttacggccaagcgattttgtgtattgatgatccggtgattcgtgagcttattccgcgtgttagccgccaagtgatcacttatggattctcagaagatgccgacgtgcgtatcgaaaattaccgccagaatggtcagcagggccaatttaccgtggtacgtaaaggcaaagcgaatttggatatcacgctcaatatccccggccgtcacaatgcgctgaatgccgctgcggctattgctgtggctaccgaggacgatattcgcgatgaagcgattttacgcgcgatggccaatacgcaaggcacaggtcgccgttttgaccatcttggagagtttgaaaccgggaatggcgtcgctatgctggtggatgattacggtcaccaccccactgaagttgacgtgacgattaaagcggcgcgtaatggctgggcagaaaaacgcttagtgatgattttccagccccatcgttacacgcgaactcgcgatttgtatgatgattttgccaacgtacttgagcaagttgatgtactgatcatgctcgatgtctatgctgctggtgaaaagcctatcgcaggtgctgatgggcgatctttgtgtcgaactatccgcagccgaggcaaaatcgatccgatttttgtgccggatagccaaaccttaccttcggtgcttgccaatatcttgcaggatggtgacttggtactgacgcaaggcgcgggcgatgtcgggaaagtagcaaggcatttagccgcgcttgaactcaatatcgggcgtatgcaacagatttaaaacagcctaaaggttgtctcattggtgaattccttggtatcaagcccagatttctgatgttgggtatttgatactttggatcacctcagtataatccggaggttaaagtcattgctttaaccctctatgacgctacgaaatagggaatcaaattgccagtcgataacaggatcaccgggctttgatcaacaaggtacttttagaaggccagagaatcacccgctcaccacaagttaaacaacatgcctgtggtgcgagtttttttctggtggtgctattgctgataggtggtttgctgtattcgacgatcagttggatgtgggacgaacaacgtctgcctctctctaaactcgttttacagggtgacttacattatgtttctgctctcgatgttcagcgggtattagcacgcttagatcatatcgggacatttatgtcacaagatattaatgttctgcaagagagtgtgcagtcgatcccgtgggtttcccatgcatcgataagaaaacagtggccagatacgattaaagtctatttaaccgaatatcaggttgaagctctgtggaatgcgaatgcgttattagataaaaatggcacggtattttatggcgatattgcacgagtaaatggtgaatacgtcaaattatatgggccagatggcactgcgccacaagtattaaaagcatggcgagattacaacccgaaatttgctcagctaggtttaaatatctcttcattagtattaaatgatcgacgagcttggcaaattattctcgacaatggtattcgtctggaattggggaaagagtcattagaagaacgaatatcgcgcttctttttgctctataaacaattaggtaataaagctgaacaagtcagctatatcgacctcaggtatgatactggagccgcggtgggttggttccctgaacaagagttaacacaagagaaaaacgatgactaagactgtcgatgacaacattattgttggtctggacataggcactgccaccgtctccgctctcgtgggtgaaatactccctgatggtcaaatcaatattattggcgctggcagtagcccatctcgcgggatggataaaggcggcgtgaacgaccttgaatcggtagtaaaatcggtccaacgggcgattgatcaagcggagatgatggctgaatgtaaaatcagccatgtgttcctttcgatttctggacggcacattgccagccgtatagagaaaggaatggggacgatttcggatgaagaagtctcccaagaagatatggatcgcgcgatccatacagcaaaatcgatcaaaattggtgaagaacagcgtatcctgcatgtcattccacaggagttcaccatagattatcaggaaggcatcaagaatccgctgggtttatccggggttcgcatggaagtgagtgtgcacctgatcacttgccataatgatatggcaagaaacattattaaagcggttgaacgctgcggtttaaaagttgaacaattggtgtattccggtttggcggctagcaacgcagtgattacggaagacgagcgcgagcttggggtctgtgtggttgatattggtgctggcaccatggatatcgccatttggaccggcggtgccctgcgtcataccgaagtattttcttacgcaggcaacgcggtaaccagtgacatcgcgtttgcttttggtacgccagtcagtgatgcggaagaaattaaagtaaaatatggttgcgcactgagtgaattggtcagcaaagacgacacggtcaatgtaccgagtgtcggcggccgtccatcaagaagtttgcaacgacaaaccttgtcggaagtgattgagcctcgctacactgaattaatggggctggtcaatcaaaccgtggattcggtgcaagaatccctacgcaaagaaggcatcaaacaccatttggctgccggcgttgtgttgacagggggcgcagcacaaatagaaggtttagtggcatgcgcagaacgcgtattccgcaatcaagttagggtgggtaaaccgctggaagtgagtggccttaccgactatgtaaaagagccgtatcattctacggcagtgggattgcttcattacgcaagagatagtcaaatcagcgacgatactgaatatcaggaacctaaacgaccctctatgacaggttggataggccgcttgcgcaactggatacaaaaagagttttaacctgagagacaggaaaaacggagataacacatgtttgaaccgatgatggaaatgtctgacgatgcggtaatcaaagtcgttggagtgggtggcggcggcggtaacgcggttgaacacatggtgcgtgaatccatcgagggtgtggaattcatgagtatcaatactgatgctcaggcactgcgcaaaacgagcgttggtactgttattcagattggtggcaatatcaccaaaggtctaggtgcaggtgcgaatccacaagtgggtcgtgatgcagcactagaagataaagaacgcattaaagaattcctaactggtgccgatatggtatttatcgcagcaggtatgggtggcggtacaggaaccggagctgcaccagtgattgccgaagtggcaaaagagctgggcattttaacggttgctgtagtaaccaaacctttcagctttgaaggcaaaaagcgtttggcttttgctgagcagggaattgaagagctatctaagcacgttgattcactgatcacgattccaaacgaaaaactgctcaaagtgttgggtcgtggtatcacgttactggaagcctttgcgagcgcgaacaacgtacttaaaaatgcagtgcaaggcatcgctgaactgattactcgcccaggcatgattaacgtcgactttgcggacgtacgcactgtgatgtcggaaatgggtcacgccatgatgggtagtggtgttgcaaggggtgaagaccgcgcggaagaagctgctgaaatggcaatttctagcccgctgctggaagacatcgatcttgctggtgcacgtggtgttctggtgaatattactgccggcctagatatgcgactggatgaattcgaaactgtcggcaatactgttaaggcgtttgcttctgacaatgcaactgtggttatcggtacttcgttagaccctgatatggcagacgaaatccgcgtaactgtcgtggcaaccggtatcggtaacgagaaaaagccagatattactctcgttgcaggtggcaaatctaaagttgcacctgtatcggctccggtgacttctcgcgtggaagagaaagcggcacagcctttgcatgaaagagttgaagtgaaaactcaaccagcagcagcgccatcgcactcttcggcaagtcagagtgtcgcgccaaagccagaaaaagagagcggatatcttgatattccggctttcctgagacgtcaagctgactaaaatatcagcgtaatttgacagtgttcagaattctggtaggatgtcggtcggtgttatgccggccgttcattgtggctaaataaatcgaggcaactagatgatcagacaacgtactctgaaagaaatagtgaaaacaactggggtgggcttacactctggtcgtaaagttacgctgactcttcgcccggccgcagccaatacggggattatttatcgtcgtactgacgtcaacccaccggttgattttcctgccgatccggcttctgtgcgtgacaccatgctttgtaccgctttggttaatgatcaaggtgtacgaatctctaccgtagagcatcttaatgctgctttagcagggatggggatcgacaatgcgattatcgaagtggatgcacccgaaattccaattatggatggcagtgcgagtccttttgtttacttgctgcaacaagcgggtattcaaacactcaatgcaccaaaacgcttcatccgtatcaagaaacctgtacgcattgaagatggcgataagtgggctgaatttgttccatttaacggcttccgtatggatttcgaaattgagttcaaccacccagcgattgatggcgatgaccaacgcctcgtgtttgatttttcttcacagggttttgtgaaagaaatctctcgtgcgcgtacctttggttttatgcgtgatatcgaatatctgcaatcacaaaacctctgcttaggtggtagctttgattgcgcgatcgtgctggatgattaccgtatcctgaatgaagaaggactgcgtttcgataacgagtttgtgactcataaagtgctggatgcgattggtgatctctacatggctggtcatgcgattgttggtgagttccgtgcctacaaatcaggccacggcttgaacaaccaactgctgcgtgcggtattggccgatcaagaagcatgggaatgggcaaccttcgaagaagaagtgggttcacctgttgcttttgctgaaccgaacatggttctcgcgtaagccattcagaaagaacaatcataataaagccagacagatgtctggctttattttttcttttaaattcaatgatatttaaacgctattctgtgagtgtaacctgctcaatcgtctttctgatttgctttcgctaaacgcgctaagctctgtaagcgttttttgactttatcagaagcttgatcggcaatcgcgagcagcacatgagcggcatgttcagagagcggtgggcgaggatttgccgcccgagcatcctcagaggtgattttgctttgccgatacaactcaggattgactcgcacttcgatactgatcaaatggccaaacccgttttgcctaagctgagtcaaaatatgtaaacgctcataatcgactttcattttgagcgctgcgctggctgcttcaagcaccaaattgccaccgcgcacattggcggcgcgcacttgggtttttaagcctttgggcaggatgtcttgtaattggcgattaataagcaaaatcgcttttgcatgctcttggatctgcttgagtttggatgcctgaatcaactcatcggtagcggtagggcggtgatcacgcatcggattctcctttggctggtgtgacgctattctaacgcgcttcttggcacatcgaaacgtacatcttagtttgccaagatgaattaaaaagcgcgagaaaccttgtaaacattgggcttagtgcacaaaaccgcaagctcgtattcaacaaatcatagagaaccttggttgttgagacaaaaattccttaaactaggcagcacttaattaactgcgtgccttgaaaataaacgctgtcatcacaatatctcacacagatgacttatctcagtatccttagttgaaaataggtagagactaaagacattccaaggtcgatagacagcgatttagcacagagagattcacaacaaatgataactaagctactgacaaaggtgattggcagtcgcaatgaccgcacactgcgccgtttacgcaagattgtaaaagagattaataactacgaacccgcctttgaagccctctccgatgaagagctaaaagcgaaaactgtcgagttccgtcaacgcattgaacagggcgaaaaccttgatcaactgttgccagaagcttttgccaccgtgcgcgaagcttctaagcgtgtgttcggcatgcgccattttgatgtacagctgattggcggtatggtgctgcatggcggtcaaatcgctgagatgcgtacgggtgaaggtaaaacgctaaccgcaacgctggctgcttacctgaatgccctacctggcaaaggcgtacacattgttacggtcaacgactacttggccaaacgtgacgcagaaaccaaccgaccactcttcgaattcttaggcatgaccgtgggtgtgaatattcccaacatgccgcagcctgctaaaaaagaggcttaccaagccgacatcctgtacggcaccaacaacgaatttggttttgactacctgcgcgataacatggcgtttcgccctgaagatcgcgtgcaacgtgctcgcttctttgctgtggtcgatgaagtggactcaatcttaatcgatgaagcacgtaccccgctgattatctcaggtcctgcggaagacagttcggatctctacatccgtatcaacaagttgatcccgctactgcaaaagcaagataaagaagattcggaagagtaccgcggtgacggtcacttcaccgtggatgaaaaatctaagcaggtgcatctgaccgaaacgggtcaagagttcgttgaagagctgctagtgaaaaacggcatgatgcaagagggtgatacgctttactctcccgctaacattagcttgctgcaccacgttaacgcggcattacgtgcgcatgttctgtttgaaaagaacgtcgattacatcgtgacacccgatggtgaagtggtgatcgttgatgaacataccggtcgtactatgccgggtcgtcgctggtctgatggtctgcaccaagcggtagaagcaaaagaaggggtgaagatccagaacgaaaaccaaactctggcttcgatcactttccaaaactacttccgtctgtatgaaaagctgtctggtatgacgggtaccgctgataccgaagcgtttgaattccaacaaatttatggtttggaaacagttgttattccaaccaacaagccgatggtgcgtaacgatatgccggatgtggtgtatcgctctgaggcggaaaagtttgccgcgatcattgaagatatcaaacagcgtgttgagaaaggtcaacctgtgttggtgggtacggtttcgattgagaaatcagaattgctctccaatgcactgaaaaaagcaggcatcaagcacaatgttctgaacgcgaagttccatgaaaaagaagcggaaattgttgctgaagccggtaaacctggcgcagtcaccatcgcaactaacatggcgggtcgtggtacggatatcgtattgggtggcagctggcaagccaaagtggagaagctggacaacccaacccaagagcaaattgatgcgattaaagctgagtggaagcaagtgcacgatcaagtgttgcaagcgggcggcctacacatcattggtactgagcgtcacgaatctcgccgtatcgataaccagctacgtggtcgttctggtcgtcaaggtgatgcgggttcatcgcgtttctatctctcaatggaagatactttactgcgtattttcacctctgatcgtatggcggcattgatccaaagcggtatggatgaaggcgaagcgattgagtcaaaaatgctctctcgctcgattgaaaaagcgcagcgtaaagtagaaggccgtaacttcgacattcgtaaacagttgctggaatacgatgacgtagcgaacgatcagcgtaaagtcgtttacgaactgcgtgatgaactgatgagcgcagatgacatcagcgacatgatcgcgcaaaaccgtgaagatgtgctgaacgcggtgatggatgagtacattccgccacaatctctggaagatatgtgggatatcaaagggttggaagatcgcctaaagaacgatttcgatctaccactaccgatccaatcttggttagatgctgacaacaagctgtatgaagaagcgctacgtgagcgcatcatcgagcaagcggttgaggtttataaagccaaagagcaagcggttagccctgcggtgatgcgtaactttgaaaaatctgtgatgctgcaaacgctagatacactgtggaaagagcatctggcggcgatggatcacttgcgtcaaggtattcatctacgtggttacgcacagaaaaacccgaaacaagagtacaagcgcgagtcgtttgaactgtttgaagatctgcttgagtcactcaaatcggatgtgatcactgtcttgtccaaagtccgtgttcagcagcaagaagaagtggagcgtatggaagctcaacgccgcgcgcaagctgaagaagcggcgcgtcatgcacaagcgcaacacgcgagtgctgatgatgctgagcaagacgagtcgaaccagccaatggtgcgtgatgaacgcaaagtgggccgtaacgaaccttgtccatgcggtagcggtaaaaaatacaaacagtgtcacgggcaaattaactaagccagtttcaccttattaaataaaagagtcgctaaggcgactctttttatacccaaacaacttgaagttacagccaacaccgctgtggctttgagtaggaaaggtatacaactgaaattcacgtcagccagaaatacaggagtcgccccttgaaacgcatccacattgttgcagggatcatcttcaactcagatcagagcgaaattttcatcaccaaacgtcccgaccatctgcataaaggcggtttttgggagttccccggtggtaaggtggaagcgggagaaagccgagagcaagccatggttcgtgagcttgaagaagagatcggcattaccgtgacggagcaacaagctttccaacattttgatttcgactatacggacaaatcgctgagcttcgattttatgctcgtgacggcttttgatggtcagcctcatggccgtgaaggccagcaaggcggttgggtgaaaattgccgatctggccaattaccgctttcctgaagcgaatgatccggtggtgaagcaagtgattgctcaatttggttaagtggttttttcctcgcttggccaagtcgtgaggctagccagagtggaagatagttggtagtttaagtctacaaattggaactgcctcaaggcagtggagaatggagacagcaagatggttagaattgcgattgcgggtgccgcaggacgtatgggacgcaatctggtaaaagcaacacaccagaatccgctttccgaattgggcgcgggctctgagcgtccagaatcctcattagtgggcgttgatattggtgagctgtgcggtattggtaaacaaggtattgttttagttgataacctagagcaagccgttgagcagtttgatgtgattattgatttcactgcgcctgccagcaccttagctaacttagctttgtgtgagcagcatggtaaaaaactggtgattggcacaacgggctttaccgatgctcagcgccaaaccattgaacaagcagcaaagaagatcccgattgtcatggcgcccaactacagcgttggtgtcaacttggtgtttaaactgctggaaaaagccgccaaagtgatgggtgactactgtgatatcgaaatcattgaagctcatcatcgccataaagtcgatgcgccttcgggtaccgcgattggcatgggcgaagcgattgcccatgcgatgggtaatcaactgagtgatgtggcggtgtacgcgcgagaagggatcaccggtgagcgttcacgcaatgaaattgggtttgccacgattcgtgcgggagacatcattggtgagcataccgccatgtttgccgatattggtgagcgagtggagatcacccacaaagccactgaccgaatgacgtttgccaatggtgcagtcaaagccgccatttggctcgcggagcaacccgccggtttctacaccatgatcgatgtgctcggattgaatgatctctaaatacataattatgcgccagcgaactgctggcgttttttttatccttaaaacttgattaaaaatcttctcatccattttcagcgaaagctaagcttgttttgttgttattttgtcttcttggtgtgcgttttgtggttttgtctttgtttttggataaaaacttggcttgttaacgattgctttatgtgtggttgtttttttgccacctatttccatttttaaaatgttctttctcaccgagtgggggatgaatagacaggaatgactgagtaaagatgtttttttgatggttttgatgaataaattcatcagactctcgtaaagataaattaaatttttaggcttgtgttgacagcctccgatcacatccctagaatatcgccaatttgtctatagcatcctaatgcatgaactcgtggctagtaggaagacgaatttgcaaaataatttatttttgatgcatttttattctggaggttgtcttgagtaaatcagcactgttagtcctagaagatgggacagtgttccgcggagtgtccatcggggcagatggtatttccgtcggtgaagtcgttttcaatacctcgatgacggggtaccaagaaatcctcactgatccttcttattcccagcaaatcgttactcttacttatcctcacattggcaataccggaaccaactccgaagacgaagaatccaccgcgattcatgctcaaggccttgtgattcgcgatctccctcttatcgcttctaacttccgcagtgaacaatccctctctgattatctcaagtcacaaaacattgtcggtattgctgacattgatacccgtaaactgactcgtatcttgcgtgagaaaggcgcacagaacggctgcatcatggcgggcgataatctggatgaagcattagcactggcgaaagcgaaagagtttccgggcctgaaaggcatggatctcgcgaaagtggtttccaccaaagaagcgtatgcgtggaaacaaggctcatggacgctagaaggcggcctacctgaagcgaaagcggacagcgagctgccttaccatgttgtggcttacgattttggtgcgaagcgtaacatcctacgtatgttggtggatcgtggctgccgcttaactgtggtaccggcgcagacctctgcagaagacgtgctcgcccttaatccagacggtgtgtttctatccaatggcccaggcgacccagagccatgtacttatgcgattgaagccacacgcgttttccttgagaaaaacattcctgtttttgggatctgtctaggtcaccaaattctggcactcgcctccggcgcgaaaacagtaaaaatgaagttcggtcaccatggtgcaaaccatccagtgaaagatttggatcgcggtgtggtgatgatcacctcgcaaaaccacggttttgcagccgatgaagcgactctgcctgacaacctgcgtgcaacccacaaatcgctgtttgatggttcactgcaagggattcatcgtaccgacaagccagcgtttagcttccaaggccacccagaagcaagcccaggtccacacgatgcagcaccgctgtttgaccactttattgaactgattaaacaattccgcgcttaatttggagtagtagataatgccaaaacgtactgacattcaaagcatccttatccttggtgcgggtccaattgttatcggtcaggcttgtgagtttgactactcaggcgcgcaagcgtgtaaagccctgcgcgaagagggttaccgcgttattctggttaactcaaacccagcgaccatcatgactgacccagaaatggccgatgcgacttacatcgagcctatccactgggaagtggtgcgtaagatcatcgaaaaagagcgcccagatgcgattttgcccaccatgggcggccagactgcgctgaactgtgcgctggcactcgaaaaacatggcgtattggctgagtttggcgttgagatgatcggcgcaaccgccgatgcgattgataaagcggaagaccgctcacgctttgataaagcgatgaaatcaatcggcctagagtgtcctcgcgctgataccgcaaaaagcatggaagaagcgtacaaagtcctcgatatggttggcttcccatgtatcatccgtccttctttcaccatgggcggcagcggtggtggtatcgcttacaaccgtgaagagtttgaagaaatctgtactcgcggtctggatctttcaccgaccaatgaactgctgatcgatgaatcactgattggttggaaagagtacgagatggaagtggtgcgtgataagaacgataactgcatcatcgtctgtgcgattgaaaacttcgacccaatgggcatccacacgggtgactcgatcactgtcgctccagcgcaaacgctaactgacaaagaataccaaatcatgcgtaacgcctctttggcggtactgcgtgaaatcggcgtagaaaccggcggttcaaacgttcagtttggtatcaacccgaaagatggccgcatggtgatcatcgagatgaatccacgtgtatcgcgctcttctgcgttggcttcaaaagccaccggtttcccaattgcgaaagtggcggccaaactggcagtgggtttcactctggatgagttgatgaacgacatcacaggcggcgcaacaccagcctcgttcgaaccgaccatcgactacgtggtcactaagatccctcgtttcaacttcgaaaaattcgccggtgccaatgaccgtctgactacacaaatgaagtcagtaggtgaggtgatggcgattggtcgtaaccaacaagaatcactgcaaaaagcactgcgcggcttggaagtgggtgcggctggtctggatgagaaagtggatctggacgcgccagacgctctgaccaaaattcgttatgagctgaaagaagcaggcgcagagcgtatttggtacatcgcggatgcattccgtgccggtatgtcagtggatggggtatttaacctgaccaacatcgatcgctggttcctagtgcaaattgaagaactggtgaagctggaagccgaagtgaaagccggtggctttgcgggcttgaaccaagacgtactgcgtaagatgaagcgcaaaggcttctctgatgcgcgtttgtcaaaactgctcggcgtgagcgaaaacgaaatccgtcgtctgcgtgaccaatacaacatccacccagtttacaagcgtgtggatacctgcgcggcagaatttaagtcagatacggcttacatgtactccacgtatgatgaagagtgtgaagccaatccgactgacaaagacaagatcatggtgctgggcggtggtccaaaccgtatcggtcaaggtatcgagtttgactactgctgtgtacacgccgcgcttgcactgcgtgaagatggttacgaaaccatcatggttaactgtaacccagaaaccgtatcaaccgattacgacacctcagatcgcctctactttgagcctgtaactctagaggatgtgctggctatcgtgcgtgttgagaagccaaaaggcgtgatcgtgcagtacggcggtcaaacaccactgaaactggcgcgagcgctggaagcggctggcgtacctgtgattggtaccagcccagatgcgattgaccgcgctgaagaccgtgaacgtttccaacaagcggtacagcgtttaggcctcaaacagccagacaacgcaaccgtaaccgctatcgagcaagcgattgagaagtcgcgtgaaatcggtttcccactcgtagttcgcccctcttatgttctgggtggccgtgcgatggagattgtgtacgatgagcaagatctgcgtcgttacttcaacgaagcggtgagcgtgtcgaatgaatcaccagttctgctggatcgcttccttgatgatgcaaccgaagtggacgtggatgcgatttgtgacggtgagcgcgtggtgattggcggcatcatggagcacattgaacaagcgggtgttcactcaggtgactcagcctgttctctgccggcttacaccttgagccaagaaatccaagacaagatgcgtgagcaagttgagaagttggcatttgaactcggtgttcgtggcctgatgaacattcagtttgcagtcaaagacaacgaagtttacctgattgaagtaaacccacgtgctgcgcgtactgtgccgtttgtttctaaagcaaccggtgctccgctggcgaaaatcgcggcgcgcgtgatggttggacaaactctggagcaacaaggcttcaccaaagagatcattccaccttactactcagttaaagaagtggttctgccgttcaacaagttcccgggggttgacccactgcttggccctgaaatgcgctcaaccggtgaagtgatgggtgtgggtgccacgtttgctgaagcctatgctaaagcagagttgggctgtggctcggtttaccctgaaggtggtcgtgcgctactttcggtgcgtgaaggtgacaaacagcgtgtagtggatctggcttctaagctagtgaaactgggttaccagttggatgcgactcacggtactgcagtgattctgggcgaagcgggcatcaacccacgtctggttaacaaagtgcatgaaggtcgtccacacattctggatcgcatcaaaaaccacgagtacacctacattgtgaacacggcttctggccgccaagcaattgaagactcaaaagtactgcgccgtggtgcattggctcacaaagtgaactacaccaccacactgaacgccgccttcgcaacttgtatgtcacacacggcggatgccaaagcatccgtcacttcagtacaagagctgcatgcgcgtgtaaaagcgaaccaagcttaattggtattacaacaagagaggctcaaggcctctctgacaacctctttgcccgctcgtcagcgggcttttttatgcacggattttggggttcagtttgatgtagcgtctgtggctaccaatgtcgcggcagtgtcgagcttgccatccttatcaaccaaaaccagacgttgatgatcacttgagagtttgacccatttgatctgctcaatttctggctgacgccaattcaggataaacagtgatgtattctcatcttgctcaaagccgcgctcggtattgagttccccaagcgttacctgcccatcaacagacatccgatagccatcaccgtgaccaatgatctccaagctgacggatttaccatccactacgccatggtagatcacaccatcgaaagcatcgtaggcaatatcatccatgctgtgatcacaactttgcgttgcctgctggtaagcacctcccgcatctaaacagcgatcttgagcgataaactcccgtccccaaaattgataaagcaagccgatggagacaaggccaatgcctagcaaagccgtgatgctctttttactcatgaatatttctctgtcgttatgtggtgaaaattgccatgcatcatagttgggttttattggttggccaaagatatttgtgaggcaaatgaaaagagtgggggaattttcttcgagaagaatggtggggggggcgaaggacacgctaacccttgcccacttatcgcgccacgatttgctgaggcttggatgctggttattccaagtattcacgaacagatgtgcctgttttgcttgctacaatgtggctggggcataaatggttttaagatctgctgcaagggcttacattgtttccaacttacaaagcagaggctattggatttttggtgcactacactatcgagtatattggtgctaatgcccgcagctgcaaagctgtttatctcatttctttatgagcttaagatcaaagttgccgttgcgagtgtttacactgtttttatcggcaacatcatgtttggcgtaactaagatgctgctctatctcggcccaagtgcatgttaggcgagtgtttttgttagctgcttatactatatattgttcaccaagcaggtattttaggtatttgtagtccgctactaactgaacgataagctggtcttatattgtcacattgtaagttctcgtaaaatatatttaaaattaccactttttataaatttattggttagttcatgtctattgtgttttgttgcttttaaaatgtatattaatctttctatttgtttttttctttctagttgtaggtgtggtttatttaagcctaacatgtcgattgtagtttgaatactatgcttttcttttctgtttttaaacccgcgaggatttataaaaccatcagtgtctaaagagaaatgactattgcatgatggtgatgtcggctcaataaataaaatgttatctttctttttttgtccacaagtttgagtcttacgattttcttgaatacatgaaacagcataattactgtaggtgaaacagagattaggttgagcatttcttcccgattttggtttaatatgttcaacttgcatttcatcaacgctatattttttttcacagtatacacatagttcaccttggagagtgtgtagtctatctcttacaattttctttactccttgaaagtcatgtgcactgaaatcttgaatggtcaaagattgaccttttaatttgacataattttcaagttcagtaggagtattattgtgtgataatggaatcataatatttatctcttagtcatcactttcagatttatcgataaaaaattcacgattttctgctataaaacgccacatttcaatgtctgctatatcaaatgtatatccagtgctttctatgcgttttttaatctctttggtctttcgacaatcttcttgtcctcttttcaccagagattcatatttttttataagagctaaaatttcttcactatgaactaatggagattcggatgtttccatgatagctagtgcatccgaggcatttttgccaaatggattgcttgttggagatagtaatttgaatctatagtctaattcattaattatttttatttgttccgaagtaactgttgttagaactagtgggctatgcgttgataggatgaattggatatttgggaaggtattttctagtttttgaacaatagtttgttgccatttaggatgtaaatgaagatcaatttcatcgattaaaacaataccatatccatttaacggattttctaagctaggatttagtattactaatcttcgagcgatatcagaaaccaaagcgataagtgttttctcaccttgagatagattaaaaatactaatctcacttccattttttataactgtcatatctaagtgaggtgttctacttatcttaacttgatctatatcggatacaaaagtttttatggactcttgaattactttttgttgtctaattaaaaattctctatcttcattattgttgtaattattttttttctctagtaattgagaaataagacttcctattttctytttgttatcagtcttagataataaatattcaatttcctcctttgttatagagtcatttgctttgaattcattaataatatcatcaatttctttgtaccaagaaaaaaaatcattgaaattagatgtgccatcaaaggcattttttagaccttcacttttatcactatatttggctttttttcgttcataatattttacagcgtcatctcttttaagagttactgaacgttcaactggataataggctaataaagggtaagagagagtattattatccagttcattagagcgttggtacatgcgtgctagagctttaaattcttcaagctcactagacacttttcttgatatgttttctctgttctttgttaggctacatgaaaaagaaaaatcattttctatttccaaaatacatcttacaatggtttgtccgcttattgaatggatattaatttctgaatcttggaatttgtagttgttattattttggattctgatgttatcagaaagaaattgtaggcatttggatatagattcaaggatagtactttttccggaaccgttattaccaataatgatcgttgtatttttttctgatgacgtgaattttaatttggagaatttcttgtaatcatacaaggagatatttctgagtctgattttagcattgttgataatacgtgacacgtttcttagatatagttcactctgttctatgtccctttctaaaacttcaccatcgtagtaatactcagaaacagtaaaggatgagtacagatctccctgtttagcctgtctaattttatctttaacatatttggggattctagttggctcattcatttagttacttcctctgagaattttttcaacgatgttcactttatatttatggctaagtcgatgaatatatataggctctatattatatgcgaacgctaacatccctttcatgtgattaatttcatcaatatcaagatttttatttatgtatttaaatactagagaagagatatatcttttcctacttcttcctattgatattttactatcgttagttaatgttataccagtaacatgacgattgtgctttttagatgagaaaacggtttttcttttattaattattattcttccagcatatgtttgtataattaactgctcaactatttctggtagcttatttaaagtgttttttatgttggttgagaatgtgatatcgtctgcgtacctggtatagttaatgccatgcttagtgcatatatcattaattattttgtcaaatgggtacataatagcattggatattaatggtgatataggagatccaacgctcaatattagctttccgttcctttttttacttgggttccagaatatcaattgttctagtttttctaactcatttactgaaagtagaatgtcattttgaattaaacattgtcgtagaatggttggagtaatactattaaaaaaattttggaagtccatttttaatacataggcagagtgactgtgtactagagcattatcttttatacttctacccttgacatatgcatagcttgagtcatgtaccttcaataatggatttaggatagcattcaaatggcgctgacaaattttgagcttactagaaggatgcgcgattgtccgccgccctgcttttcttttgggaattgagtataccttatatgcatgagagcctctaacctcaagtctctcgaactcctgaggcataattacattgtttgttaaaagttgctctcttaatgtggttagtatattcaattttgtccttttaagagtaaacaacccaagtataaattaacttgggttgttgctagctctttactagagacagcgaaatggaggtttttctctcctctcgcagttcagggaaatgcgagaggagagaaaaacctccatttcgcaaccccagtgtcgttcaataaatttcagtctggctaaacgcccgactagactaatatgtgtagtccattcgctaaagagcacaacaattttaattcatatagaatcacttcacaagcataccgattgcgcagtaatgtgagtctaatggatctaatggatagattaattgaggaatgggtataggaacctgtgaccagccgcctagggctaggtggtacatgtaatagggatatgtgtaatatcgatgaataaatggaatagattgtcgtcttgcgtttcgctgttttgatgttttgagcagtgatactgttgggctttgtcattcaagatgttgattagaaatggaactttcactggaagtattggggctgctgtttttagtggcgggagttgcgggattcattgatgccatggcgggcggtggcggtttgctgactttaccagccttgctggccgcaggggttcctccgactcaagctctggcgaccaacaaactgcaaagctcctttggtagcttttcggccacgctctattttgtgcgcaagggcgttgtgagcctaaaagcgatgcgattggcgattgcttgtacttttgtcggcgcggcgcttggcgcagaagcggtgcaatatattgatgccactttgctgaccagccttatccccctgttactgctcggaatttcgctctatttcttattggcaccgaccaccaaaacgcacacagggcctgcgcctttatccgaaaccgcgtttgccttcacggtaggttttggtatcggtttttatgatggcttttttggccccggtacaggctcaatttttaccgtctgctttgtggctttggggcattttagtttagttgaagccaccgctcgcaccaaggtactcaattttacgtccaacattgccgcgttgaccttcttcttaatcgctggtttgccgatttgggaaattggcttaaccatggcggtaggtggatttatcggcgctcgtatgggcgcaaaagtggtgattagcaaagggcagcgttggatccgcccgttggtgatcaccatgtctatgctgatggcgctaaaactgctttgggaacagcatcatgcagcgctgttatcaatgcttggactctagagctgcgataccggctggcccgcagacaaatatgaatcggccgagtaaggtctgctaattcagcaaaatcaaagcagtgttggggctctatttttagggtactgacaatcgagcgtggcactagggcgggtaacatgccgccgagcgcgagctgcgccgccgcggtgtaagagtccatctccatcgcgggtcgaatgccttgtttgtgcagcatggccgcttgataggtattggcgggattggctaaatcattggtgataagctcacttggcagtgcgtgcagcggcgcttggctaatcacggtaaatggctcatcacctagatgaaaggtcagcaaaccgtgattggcgggcagatagccggcacaaaagcctaaggtggctttgccagattgcacattctcgacaattcgcggtgtgtggttggtggtgatcacccaatgcggatcttgcttgcgatgttgccccatcgtctggccaagataacccgcgactaacgtctccgagcaatccatacgcagcagcgtgttatcttccagtgtctgctgctcgaaaatcaaaccatgcaactcattaaaggtggggccgatactggcaattaattgctcggcatccgcggtcaatttgatatgtcgccccgctggaacaatcagtttcttgccgagttttttctctaaattcacaatgcgtttactgactgctgactggctgatatagagctggctaccggttcggctcatggttttttctttgctgagcaccagtaaggtttcaatgccttcgagtaacatgtgttgatgacaaatgggaatagatgcgtggattgtatgtggaatctcaagcgaggtcgtgcattaagctcacaaagtgaactgagctttaaatacgagggagatttttgggatagcggcacctcgcatggggcgttaggtgccgagcctgttatttggtcagggcaaaggttggcagagaaaggtgccagcggatcgctccgagacgaattaagagcgtggaaaaaacgccagagagcagagcggtcgagctgctgtagcccatcgccagtgcggtagtgtggaaaatgccaccgataatacaggcggttgcgtacacttcactgcgcagcaccataggaatttctcgggcaaggacatcgcggataattccaccgccgcagcccgttatcacgcccataatgatcgcgattaaggcggaatcttgatagatcagcgctttttcaaccccgatcccgacgaaaaccgcaaggccaatcgcatcgcacacgggcaaaatccaccacgcgagtcttttcgggcgacgcaccagtagcatggtcagggcgcaggtgatcataatcacccacaggtagttggtgtctttgatccaaaataccggagtggctccgagcgccatatcgcgaatggtgccgccaccaattgcggtcacgctggcgaggaccatgacgccaaacggatccattttcaaacgccccgctaagagcactccagaaaccgcaaaaacggcagtaccaaacatatcaatcagataaagcagagaagtatccaaagcggtctcactatctacacaacgatgaaaaatatcgagcaggcaaattggggcggattttacgagatttaatccgctaaagttactgcttttgtgcaattttgaggtatgtgcacacttgctctaccgcatctagggttcttggggtcgggcggtttaaccaatcggcattgagtgcccaaacctgatcgttttgcacggcgctgagctctgcctgccaagctcgccacatgtggccattggctatcgcatgctctgaggtaaaaatcacttgcggctgtttaaccaagacttgctctatgctcacttgcggatagggcacctcactgtcggcaaaaatattgacgcccccacagaggctaaatacttcactcggccagtgaccttgagccaaggtgatgatgggtttttcactgagttgatagaaataacggatcggctgattgctcgcgtattgcgtgcgtaaatcctgtaaacgttgccgaaagtcgtgtgccgctttttgcccaacctcagggttggccgaatagtgactcaatgcttcgatattatcggcaatttcatccaatgttttggtttgtgaatcgtaaatcgtaaaaccgagttggcgcagtttagccaattcacgcggtggattgcccgctggccaagcgatgatcaaatcgggtttgagcgtcaggattttctcgatattgatggtttgatgattggcgacgcgctccagttcgagcgcttgtggcggatagtcgctgtactcgctcaccgcaaccaacttatcacccaaaccggcggcataagcaatttctgtcgcgtgaggggcaaggctgatgatgcgctcggcgggaaaaggcttggccaataagcttggggtgatgaacagaaacgtgcaggcgataagccggataacaagcatttatactccgcgataaatcagtagtaacagtaaactttctagcgcaatccagacaaaaatacgccacgcgataaggctttgcacttgcgcaatatgaatcgccgctggggcgatgcgcccgccaattttggcgcgtacgcttttttgctcaccataaatggcagggccgcctaaggcgagctgcaatttattgccaaccgcacacagtagccaagcgggtcccggcaatggccaactgcggctttgttcgagtaccgttttgaaaatcgtccccgcttgtttaccgagaataatcaacagactaaataggcgcagtggcaaccaatcaagcagcgcgagaatacgcaccgcagtaaaaccaaacggttggaaggtggtgcgcgacggtgaccaagcacgagccagttcggcaattaagcgatacaagaatgcgccgctgccgcccagtactccataccaaaacagcacgccaatcacgttacggccaaagcccatgactaaggtttccactcccgccttgccaagccccagcgcggacagtgtcgtggtctggcgattgacaaaaggttgtaataaggcgcgtgcttgtggcttgtcctctttcgcgagagcttgtgccagttgattggctaaagtctcttggcgtcgccaatctaatgacagaagcagcagcgctaaatcaaacagttgtggttgccagactaagggtttgagtgcccaaagaagtgccatcgtcgggaaaatcatcaaaccccatgcgagggcgccagacaggagattttgtgcataactggctggtgtgttgaccttacttgccagcagttcagcaaacttgtgccacaaagtgactggatgcgcagcatgaggaataggcagcagcagatgaaataagagtgcgccccacatcacgaggagcgcaccattggcataaaagtgggaaaacccagtttccattaatgaactcgcttatttgagcagttcgaccattttcagcaccatagcggaagagcttttggcggccagtggcaagaactcttcaaacgacagtggagattctttatcagcaacgtcagaaatcgcgcgaaccaccacaaagggcaccttgaattggtgacaagtttgcgcaatcgcagaggcttccatttctaccgcaacaacgcttgggaaatgttggcgaataaattgctgacgttcagcggtgcacacaaacgcatcaccggtacagataaggccacgcaccgcatgagtatttggcaattgagccagcgcttgttccgccactgtcatcaatttctcgtcggctttaaaggcggcgggttggccagccatttggccaatttcataaccaaatgcagtcacatccgcatcgtgatggcgcacttcgcttgaaatgaccacatcacccacattcaaacttgcgtcaaagccgcccgcagaacccgtattgatcaccacatccggcgcatactggctaatcagcaaagcggtgcctaatgctgccgagactttaccaatgcctgattgcagtaaaacgacgtcgacaccttggatttgaccgctgtaaaaagtacaaccggcttggttaacttcttgcacgtcttcgatgagatctttcaggatggcgacttcttgttgcattgcgccgatgatgccgattttcataggggctctctttcatctatcaataggaaaacaggccgcagtgtagcatgagcgaacgcaatcgatcgagattaggggcgatcgagattagggttgctcaagtaaaccagacagcgtgagcttttcgcgcagctcttcagcgcggcgacgattcactccaaaatcactgtagccaatccgcgattcagagcgaacccataagtgatcttgttcgattttgagttccagatcatcgacgaagcggaatactttggaggtgcattcgatacggagatactgggcatttttttcagcggtcaccgcaccaggaagagaaagggcaatccgttcaacctgctcaatcgtgacccctgggcgcaaaataaacggtgcaaggttaaatttatcccgctcatcttgagttgaaacacagttcggtcgattggcgcaaggcgtggcggtgcggtctggcatagaatcgactccctgactgcaggcggtaagcgaaaaggcagcaataatggcataaaacgatgggtgcatgttggtaagctcactctcatctcagatcccccattcacatgaggtggcagatggagtgtccgccactgcaaatcgtttagggttatcaatctattttgtgctcattataggtagcaaaaataaaaaaggatccataacactatgaatcctttgttgtttgcttcgatctaatcccaaaactgtgagctagactccaagatagtcgagaattccctcggcagctttgcgtccttcatcaatggccgtgaccaccagatccgagccgcgaaccgcatcaccaccagcaaaaatcttgggattggtggtttgatactggtaagtctgcttggcaggggctttgatgcgtccccactgatcgagctcgacatcaaacggctctaaccaagccattttgtgcggttggaaaccaaacgccatgatgacggcatcggcaggcaagacgtgctcgctgcctgcgaccggttcaggtttgcgacgacctgccgcatccggttctccaagcgcggttttgaccactttcacgccagtcacttggccttgggcattcacttcaattcccagcggctgcaagttaaacataaattcaacgccttcttctttggcgtttttcacttcacggcgtgagccgggcatgttttcttcgtcacggcgataagcacaaatcacgcgagatgcgccttggcgaatcgaggtgcgcacgcagtccatcgccgtatcaccaccgccgagcactacgacattttttcctgccatatcaatgaatggcgcctcgttgttaagttccatcactttataggtgttggagatcaaaaacggcagtgcatcataaacgccgggggcgtcttcgttggctaagccagcacgcatatattgataagtgccgacgccgagaaaaaccgcatcgtactcatccagcagttgttgcagtgtgatgtcttggccgacttcgacattgagacgaaactcgatacccatctcgctaaaaatgcggcgacgattttccatcacccctttttcaagtttgaatgagggaatgccaaaggtgagcagaccgccgatttcgggatagcgatcaaacacgacaggtcgtacaccgttgcgaaccagaatgtccgcggcggcaagaccagctgggcccgcgccgatgatcgcgacttttttgtcggtccagaccacgttggacatgtcgggtttccagcccatttcgaaggcggtatccgtaatgtatttttcgatgttgccaatggtgacggcaccgaaatccgcattcaaggtacatgaaccttcgcacagcctatcttgcgggcaaactcggccacacacttcaggcaggctgttggtctggtgcgccaaatcggccgcttcgaggatgcgtccttcattggcgagctttaaccactgcggaatgtagttgtgtactgggcacttccattcacagtaagggttaccacaatcgaggcagcgatcggcctgcgcagtggcttgttgcttagtaaagggctcgtaaatttcgacaaactcaattttgcggatgtgcagcggttttttggccggatccacacgattgacatcgataaattggtaaacgttttggctcatcaatcaggctccttccaattattgtgcttgcacgcgcagttcagctgcgctgcggctctgatggccgagcagggtacgtaagtccgctgcttgtggtttgatcagatagaacttcggaatccattcatcaaagttcgccaaaattcgctctgcgtgggcggagccagtctcttcgagatgttcagcaatcaacccgcgcagatgctcttgatggatatataagtcggtcaaggcaaccgcttcaacggattcatcattgacgcggccttggaaatcgccattctcatcgagtacgtaagcaaagccgccggtcatgcctgcgccaaagttcacgcccgttgcgcctaaaatggcgacgatgccaccggtcatatattcacaggcgttatcgccagcgccttcaatcaccgcaatcgtgccggagttgcgcaccgcgaaacgctcgccagctttacctgcggcaaacagtttaccgcccgttgcgccatacaagcaggtgttgccgataatggtcgcttcgttacacacaaaagcggtgccttggtgggggcgaatcacaattttgccgcctgccatgcctttaccgacatagtcgttggcatcaccggtgagatacagctcaagaccacctgcgttccagactccgaacgattgccctgcggtaccattgaggacgaccttgatgggcgaggtggcgacgccgagattgccgtaacgtttcgcgatttcaccagagagacgcgcgccaatcgaacggtcggtgttgatcacgttgtaatagagctccagcgattgctggttttccacggctgctagcgcatcttcgacgattttctggttaagtgcccctttatcaaacggcgtgttcggttcggtgcagtacagtggcagattttgtggtgatacaggtgcttcgagcagatcggagagatccaatttgctctgtttcgcggtcatgccttctaccacctccaacagatcggtacggccgatgagatcggtgagcttctcaacgcccaattcggccagataaccgcgcacttcttcagctaagcctttgaaatagttcatcaccatctctggcagacctttgaagtaatctttgcgcagcgtttcatcctgcgttgccacaccggttgcacagttgttgaggtggcaaatacgcaagaatttacaccccatcgccaccataggcgcagtaccaaaaccaaaactttccgcgcctaaaatcgctcctttgatcacatccaatccggttttcaaaccgccatcgacttgtagacggatcttgtgacgcagaccgttggcgaccaaggcttgttgcgtttccgccaaaccgagctcccaagggcttcctgcatattttacagaggtgagcgggctggctgcggtgccgccgtcataacctgagatggtgataaggtcggcgtaggcttttgccacaccagtggcaatcgtgccaacgcccggctcagagacgagcttgaccgagaccaaggccttcgggttgatctgtttaagatcgaaaatcagctgcgccaaatcttcaatcgagtagatatcgtgatgcggcggcggcgaaatcaaagtcacaccgggaacggaataacgcagtttggcgatctccgccgtgaccttatgccccggaagctgaccgccttcaccgggttttgccccttgcgccactttaatttgcagcacatccgcattggttaaatagtgcggtgtaaccccaaaacgaccagaggcgacttgcttgatacgtgagttacgctcagtgccaaagcggcgtggatcttcaccaccttcacctgagttggaatagccgcctaggcggttcatcgcggtggctaacgcttcatgggcttctgggcttaacgcgccaatcgacatggcagcggagtcaaagcgtttgtagagatcgctcgcgggctcgatatgctccagtggcagcggtttatccgaggttttcaaacgcagcaaatcacgcagcatggcgactgggcgctggttgacttgctgagcaaactcacggtaatccatgatttcgccggatttgaccgctttttgtagggtaccaaccacatctgggttgtaggcgtggtattcgccaccgtgaacgtatttgagtaaaccaccgtgttcgagaggcttacgttttgcccatgctttacgcgacagattaaacagatcttgctcaaaatcgtcgaagttcgcgccttgaatgcgagtggtaacccctttaaagcagagatcaaccacatcgcggtgcagacccaccgcttcaaacagttgtgagcagcgataagaggcgacagtcgaaatgcccattttggacatgattttgtacagacctttgttgataccgtattggtaattctgcatcacttcgcgatagctcttttgcagcgcgccatcatcaatcattttgcccagcgtttcgtaggcaaggtaaggataaacggccgtggcaccaaagccgatcagcaccgcaaaatggtgtggatcgcgcgcggcaccggtttcaataatgatgttggcatcgcagcgtaaattggcttccaccagacgagcttgtactgcaccaaccgccatagcagcggggatcggcagacgatccgcggttaatgcgcggtcggagagcaccactaaaacggtgccttcgcgcaccacttgttcggctttgtcacacaaatccaacaccgcttgtttgagatttttctcttgcggatcgaagttgatgtcaagaatggtgttgcgatagtgctgatcgctgagcgtcagtaactgctgcatatctgagtagagcaggatcggcgaatcaaaagtgacgcgatgggcgtgaccatcggtttcgcaaaatacgttcatctcttggccgatgctggtggccagcgacatcacatgtttttcacgcagtggatcgatcggtgggttggtcacttgagcgaatttttgccggaaataatcgctgatcaggcgctctttggaagaaagcaccgccatcggcgtgtcatcgcccattgaaccgaccgcttcttgtgccatatcgccaagcacgcgcaggatttgatcgatctcttcgttgctcatcgcaaactgcttttgataggtttttagcaagtcagcatcaaagctgcgctcaccaaccttatcatcgggcaactgtgaaaagggcgtgagtttatgaacgttattttccatccactcacgataggggtgacggctttttaggtcgttatcaatttcgctcgattgccaaattttgcctttgcgagtgtcgatcaccagcagctcgccggggccaacccgacctttttcagacacttcatctggtgcgtaatcccaaatcccgacttctgaagcgagggtgatgagcttatctttggtgatcacataacgcgcaggacgcaggccgttacggtcaaggttacacgcggcgtaacgaccatcggacagcacgatccccgccgggccatcccaaggctccatgtgtttggagttgaaatcgtagaaagcacgcagatccggatccatatccggatggttttgccatgcgggcggaaccagcatgcgcatcgcacggaagatatccatcccgccggctaaaaacagatccagcatgttgtctaggctcgaagagtccgaaccggtttcattcacaaaaggggcagcgctttgcaaatcgggcagcagcggtgacgcgaacttataagcccgagcgcgtgcccactggcggttaccttcaatggtgttgatttcgccattgtgcgccagatagcgaaacggctgagccagcggccagcgtggctgagtattggtggagaaacgttggtggaacaagcaaatcgccgattccatacgcagatcggctaagtcgagataaaagcgtggtaggtctgcgggcatacacaggcctttgtaaaccaacacttgagtcgagagcgagcagatgtagaaatcgcgatcatccgtaatctgtttttcaatgcgacgacgcgcaatatacagacggcgctcaacatcgcgctcacgccaaccggccggggcggagatgaagacttgttgaatatcgggcaaagagtcgagggctatcgggccaagcactttcgggttggtgggcactttgcgccaacctgccacgcttaaggtttctttagcgagttcttggttaacaatttgctgtgccagctgcgctttgtgtggatctcggctgagaaacagcatgccaatcgcgtactgtttgctgagtttccaatgttgctcttctgcgatcaggcgcaaataagagtcaggtttttgcagcaacagaccacagccatcaccagttttaccatcggcggcgataccgccacggtgagtcatgcgatcaagtgctgaaatcgcggtacgaacgagtttgtgactggcttgcccttccatgtgcgcgatcaagccgaatccacagttgtctttttcaagacttggatcgtatagagccattgcaattctccctttgcatctctgtcatccagacagtaaatgacaattcccttactccttgaaacagcctcggtatgggcggtgtctgtctactccaatcacatagttatctatgctgatggggattcatccacttccgtttaacgatggcttcaagtagcttgggtataactattcatttaaatctttataatttgaataattaactaacatttcaggttaattaattaacatttttgcgggattttattttcaccgaattcacaacctatagcttattgtacaaaaggtcaagttattggttgaaaatagggtttgcagggtatttgccgaggaatacttcaaataatgtcattatattcaatgggatagttttctctcagttacagataactcaaggttttatcccgtgtgatgagaataggcataaaaaaggccagcagggagtgctggccgaagtaaaacaatatggaaggaaacggttgtgttgacacggatgaggatgcatcacccgcgccaacagaggattatgctgacagcatgagtgagtccgcttttgcctcaagatgggtattgcccatcaagaaggtgtcaacggctcgcgcacattcgcgaccttcgttgatacagcgcaccaccaaggattggcctgtgcgcatatcacctgcggcgaatacgcctttttggttggtcgcaaaatcttgcgtcgccacattgccgcgctcatcaagcttaatccccaactgagcaagcacgccgtgtggctctggatgcaagaagcccatcgccagaaatgccatatcacaaggaatgacgcgttcactgcccaccacttcgtcaaagcttggtcgctcaccgggggctgcatctttccaaacgatgtcagcgatgcgtagacccgtcacttcaccttgttcattaccaatgaactctttggtgaggatgttccaatgacgctcacagccttcttcatgagaggtagaggtgcgcagaatcatcggatattgcggccaaggcatattcactgggcgcttttgcggtgggatcggcatgatctccacttgagtgatactcgcagcgccgtggcggttagaggtgccgacacagtcggagccagtatcgccgcctccgatcactaccacatgtttgcctttagcgtggatctcttcacctttcagatccatgccattggctcggcggttattttgcgcgaggaactgcatcgcgaagtaaacgcctttcagatcacgtccgggaatgctcagatcacgtggtacggttgagccgcccgtcagcaataccgcatcaaactcctgacgcaactgttgagcgttgatgtctacaccgatatgcgcattgaccacgaacttaacgcccgcttgttccatcagattgattttgcgatcaatcacatccataccgagtttgaaatcgggaatgccaaagcgcagcaagccgccgactttttcatcccgctcaaacacggtgacgctatgacccgcggcattcaactgctccgccgcggccagccccgcagggcctgagccaatgatcgcgaccgtttttccggtgcgtgaacgtggcgttttcggcttggcatagccttcttggtaagcacgttccacaatggttttttcaatgttacagatggtgatcggatcttggttgatgccaagcacacaggcggtttcacaaggtgcagggcagacacgaccggtaaactctgggaagttgttggtcgagctcagaatattccaagcctcttcccaactgtcgcgatacactgcatcgttaaactcgggaatgatgttgccaatcgggcagccgttatgacaaaacggcacgccacaatccatacaacgtgaagcttgctgattgatcttcttaccaaactcttggttaaggacaaactctttgttgtttttgatgcgctctgccgggtcgatttttttcggcagttcacgaccaaattctaaaaatccggttgctttacccatttataccgcctccgctgctaatgtggcttgttgctcctgtgctttacgcttttgcagtaccgctttgtaatcacgcggcatgaccttgaccatagtggctaggcttgcgtcaaagttggcaaggaaagctttggccacttcacttcctgtgaattgaacatgcttggttaacatctctttgagtagggctctgtcttccgcttcgatagggtccagatcaaccaattctgcattgagcttagattggaagtcgccagatttatcccacacgtaagccacaccgccactcatacctgcggcgaagttacggccggttgaaccgaggatcactgcgacaccgccggtcatgtattcacagccgtgatcgccgataccttccaccaccactttggcacctgagttacgcacgcagaaacgctcgcccgctaggccgcgaatgtaagattcgccagaggttgcgccgtagaaacagacgttaccgaccacaatgttctcttccggaactatggtggcgttacggttcgggtagagcaccagcgtgccaccagaaagacctttgccccagtagtcgttagcatcgccttccacttcaaagtaaacgcctttagtgaggaatgccccgaaagattgtcccgcactgccgttgaatttcacctgcattggctgtggtagaccttggtctttgtaaaccttacagatttcgttagacaacatggtgccggtactgcgatcggtgttgatgatcggtagctctgctttgaccgcttcaccacgctcaagggcaggcgttgctaattggatcaaggtgcgatccagtatgctttcgagctggtggttctgctgagtctggcagtaaataccatcttcgctgcgcggctgctcaataaagaggatcggcgacagatcgaggtttttgtacttccagtggccaatatcatcacgcactttgagtttgtgcgcttggccaaccatttcgttaatggtgcggaaaccgagctcagccatgatttcacgcaggccttgtgccatgtattggaagaaggtcacaacgtcatccacacggccagcaaaacgctcacgcagagttttgttttgtgtggcgataccgacagggcaagtgtttttatgacatttacgcatcatgatacagccttcaaccaccagtgcagcggttgcgacgccccattcttcagcgcccaacagtaccgcaatcgcgatatcgcgtggggttttcatctgtccatcggcttgcaccacaatgcggttacgcaggccgtttttgagcagagtctggtgggtttcagccagacccagttcccaaggtaaaccggtatgacggatagaagagatgggtgatgcacccgtaccgccatcgtgaccggcaatcagtactacgtcagctttggctttagccacacccgatgcgatggtgccgacaccggcttcagaaaccagtttgacgttgacgcgacctttgcggttggcgtttttcagatcgaaaatcagctgggctaagtcttcgatagagtaaatgtcgtggtgcggtggtggcgaaatcaggccgacgcccggtgtcgagtgacgagttgccccgatccattcatcgactttatcacccggtagctgaccaccttcgcccggtttcgccccttgcgccatcttgatctggatttcatctgcgttggtcagatagtaagaggtcacgccgaaacggccagatgctacttgcttgatcgctgaacgctctgaatcaccgttggcatttagctcaaaacgcattgggtcttcaccaccttcaccggagttggatttcgcgcctagacggttcatcgcaatcgccagtgtggagtgcgcttcgtaagagatagacccaaacgacatcgcaccggtggcaaagcgcttcacaatgctctcgatcggttccacttcctcaatcggaatggaacccgctggatttttcacaaaatcaagctgactgcgcagagtaacggctttatcgccttggctatccaccgcggctgcgtacttcttgaactgctgataatttttgtggcgagtcgattcttgcagcaggtgaatcgtttctgggttaaacagatgctgctcaccacgctgtttccattgatacacgccgccgacatccagcacttgcagtgggatttcacgcgttgggtaaccaatgcgatgacgaaccaacacttctttagcgatgtcgtcgagggtcaaaccttgaatacgggtgatggtgccagtgaagtatttatcgaccaccgctttactgatcccgagcgcttcaaaaatctgtgcaccgtgataagactgcagcgtcgaaatccccattttagagaagatcttcaacagaccgccgttcacgcctttacggtaattctcgaagtatttctctaccgaaacatcggcatcgagtttcttctgacgcttgagatcgacgatggtttccaccactagatacgggttgactgcgtttgcaccgtagccgagtagggttgcaaagtggtgcgtttcacgcgcatcaccagtttccaccacaatgccgcatttcgaacgcagacctttgcggatcaggtgatggtgcaccgcgcctacagccagcatggctgggatggcggcgtggttggagtttaccgcgcggtcggtcagcaaaatgatcgaatagccatcaatcaccgcatcttccgcgtattggcaaatacgtttcagagcgcgttcgagcttgcccggttcatcgctggcacgaaatacgatgtctaaggttttggcttgcaagtgctcgttatcgattgcccggattttctcaagctcagcattagaaatgaccggcgattccaattcgaccttacgacagtgcgcaggggtttctgctagcaagttttgatcgcggccgatataagtgttgagcgacatcaccatgcgttcacggatcgggtcgatcggtgggttggtcacttgggcaaacaactgcttgaagtagttggagagatgctgagattggtgtgacagcacggcgaccggccagtctgcccccatcgaaccgagcggctcataaccagtttgcgcgagagtcagaatgatgtcattgacctcttcgctactcaccccaaacgcttgttggcgatggaggagacgctctggcgacggttggctatgtacgttgtcggcatccggcagttttttcaaactgagtaggttttcttctacccatttttcataaggctgcgccgaagcgataccgtctttcacctcttcatctgagataatacggccttgttctaagtcggcaacaaagatacgtcccggttgcagacgaccacggtattccacattggccggatcaatttccacgacgccagattcggaagccatgatcagaaaatcgtctttggtcacggtataacgagacggacgcagaccgttacgatccagtgtggcgcctacttgtaccccatcggtaaagcacactgatgctgggccgtcccaaggttccatgacgttagcgtggtattgatagaaggcgcggcgcttaggatccatcgctttgttttcttgccatgcttctgggatcatcatcatcagagcgtgaggcaagctgcgaccggaaagcaccagcagttcgagtaccatgtcaaagttagccgaatcggatgcgccttcttggcagataggcagcagcatatcgatttcagcttgagtaaacagcttggattgtaaaatcgcttcgcgcgctttcatccagttcaagttaccgcgaaccgtgttgatctcaccgttgtgcgcgatgtagcggaaaggttgagccagtcgccatttcgggaaggtgttggtcgaaaaacgcgagtgcaccagtgctaacgctgtcaccatggtcggattttgcaagtcgaggaagtattgcggtacttgctctgtagtcaactgacctttatagaccaaggttttgtacgacatcgagttgatataaaaatcatcaccgatgttcgacacgctctcaaggcagacgcgaacggtgtagttacgcagcacgtacagcttgcgttctagctcgtcaggctgcatacccgggccgccagaaataaacacgtgttcaaattgtggttcggtactgagggggtcggcacccaacatgctgttattggtcggtaaaacgcggtagccaatcacatccagatcaaggcgtttggcattgcgttctagaatgtcgcggcattgggcgcgtttatgttcatctttcgggaacagcaccacaccaacaccgtacttttcgaatgaaggcagcttgatccccagtttaaccgcttcttcgagtaaaaattcgtgaggtttttgcaacaaaatacccgcaccgtcaccgctgcaagggtcacaaccctgaccgccacggtgttccatgcgtgcgagcatgtccaaagcttgagtgaccacctgatgagacttgcgatttttcaggtgagcgacaaagccgatgccacaagcatcatgctccagctcaggcgtataaagaccacgcgaacgttgcgctttatctaccatagatacatccttccagttattgaggacgcaaccgcactgagtgtgcactcagttattcccgccacgcatcaagcagcatccgctgaatgagtcgcttgggcgatacgtcctgtcctttttgttttgagtgaaatctgcttagggagcagatccgcgtcctttccgtctctcacaggaaatatattgtgagaaagacaatccttagtgacattcctgttgtcgagccactttactagtggattcttttggtaggtgtggaatatcaccgatagtctgccgcgttttttgtaattaattgagcaaaaaagcacggaaaactgaaagtatcctacaattttgctggcgcaaattccaacgaaaagtctgcggtttggtttatttttttacagctagatgaatgttttgtttaacaaactagaaacaaaatgcaaatagtgtttattttatgcctatttattgatttgacgctgtttgaaatcaaacgcgagggattaaaatttgtgaccaattcgattggaaatgtaattaaattacacggatggtagtgagagatatttgtatttagattgagcgagccgatgcatttacatcaactggtgaacaccataggtcaagatttacaacgccgttatggagagaaggtccataagttaacgctgcatggtggattcagttgtccgaatcgcgatggcacgataggccgtggcggctgcactttctgtaatgtggcgtcgtttgccgatgaaaatactcagcagcagagtattcaagcgcagttgaaagatcgggcgggggagatcaaacgcgccaaaaaatacctcgcttattttcaagcttacaccagcacgtatgcggaagtgcaagtgctgaaatccatgtacgaacaagccctagaagaagcggatattgtggggttgtgtgttggcactcgtcctgattgtgtaccggatgcggtgcttaagttgctcgccgattatgtgcagcaaggttatgaaatttggcttgaattgggtttacagacggcgcacgaccagactttaaaacgcattaaccgcgggcacgattttgcctgctacgcagagatcactgccaaagctagagcgttaggtatcaaagtgtgtactcacttgattgttgggttacccggtgaagagcgcactgaaaacctcaccacgttacagcaagtactgaaggtaggcaccgatggcattaagttgcacggtttacacatcgtagaaggcagcactatggccaaagcgtggcgagcggggcgtttaacggtactcgatcaggatcaatatgtgtccatcgcttgcgagatgatccgttctacaccccctgagattgtttatcatcgcgtctcttctgcagcccgcaggccaacgctacttgccccgttgtggtgcgaaaatcgctggtgggcgatgacagcgattggccaaagattggaaaaagaaggggctcagggctcgttgctcggtacgccttttgagtattcacctttgaacttaaagtaataatccgcagcaaagtcagataatcttttgtactatttaaagaatcatcaataacaccgctgaatgcatgcctgaatttctctctgaatttgtacgtttcttgttcgctgccgggcttgtgcttggtggtgggttatggcttttttcaggatggcagcgctatgttcaacctcaacagtggattcagttacttcaccatgcaccgtcagggatgctcttggtaggagaggatcgcgttttacgtgccaatcttgccgcgtatttgttactggggatccgcttggtgggacgtcactatctgttttctgccgagcagagtgaagagagtcagcaagctttttatcgagcgctcgccagcagtgcacagcaaaagcgttccgtccctctgctttggcctgtgccgggcaatttgacccaaactctagagatctcagcttcgctcttacgtcgttggccgaagaaattatggctagtgaatgtgattggttttgagtgtcccagccatgacattcaacaagagcgccactcactggcgatagcgcgcacggcacttgattccctctccgagctgatttttattaaaagtaccgaaggccacttaatcgcaaccaaccgagcgtttgatcagttttggcaaggccggattgaagagggcagcgctacttttaaaggcattatgaaagggcgcacgagtcagcgttgctggactgtgacgcctgatgggcgcagctgtctgttagaaacctaccaacgggtattgatgtcgccgcaaggtgaaaatattgggctacttggcatcagtcatgatgtgaccgactggtacaacatgcagcgtcaattaagagaagagatggaaaaacgccgtgacaccgaagtggcattggcacagcgcgatacgattttacaaaacatcttagaatctagccccgattcgattggtatcttcaatgaaaacatggtctaccaagcctgtaaccagccgtttgtggaagctctcgggatcgcggaagtgtcagatctggttggtaaacggctgcaagatgtgatccccgagcacatctatgcgcgtctttccgatacggatagccaagtcctgcaccaaggtaagtctctgcgctacatcgacagaattgaacgctcagatggtgagtttatctggtttgatgttgtgaaatcgccttttcgagatccggcttcgggcaccaatggcgtgctgatcatggcgcgagatgtgtcggagcgctatctcgccgctgaacaattagaagccgccaaccaagagctggaacgcctaagctttttagatagcttgactcatgttgccaatcgtcgtcgttttgatgaacaactgcataccctctggcatttgcatgtgcgtgaaggcaaaccattaagcatcattctgtgtgatgtcgattatttcaaagattacaacgacgcttatggccatttgatgggcgatgagacgctcaaacagatagcgattgcctttactcaagtcgccaatcgccattctgattgtgttgcccgctacgggggagaagagtttggtattttgctgcccaatacaccacagtccggagcaatactggtcgcagagcgaatccatgagaaagttcgtggattagcgattccacatgatcattctaaggttgccgataggattaccgtcagcttaggcatagtgacgcttattcctcggcctgaggatgtacctgagcaaatggttgagctagcggatcgggctttataccaagccaaagcgaatggccgcaatcagacctcaatttatcaaccaaaccactaaaactgtgcggttcgccctgtcacagcgccaagaagtggataagtgctgctaacgtttgtgtgggaaaaaggctagactaagtgctctttatctgacggagcagtgaatgaaaccgatgaaaaatctcgcccagtattacgttgatttgttagtcaaattgggcattttacgtttctccattctcttagctctcgccttggttgctttggctgtggtggtacaagtggggatcacgctgatcctcaacggtttcgtcgatgatatcgacattatccgctcggtattctttggtttacttatcacaccttgggcagtgtactttctttctgtggtggttgatcagcttgaagagtcacgccaacgcctctcgaaattggtgtctaaactcaaagacatgcgttcgcgcgatcaagaactcaatcaaaaacttcagcaaaacatcgttaaactcaatcaagaaatcgaagaacggatcaaggcagaagaggcacgcgaagaagcgatggctgaccttgaaaatgaagtgtatcagcgtgaaaaaacccaagtggaattggccgaacgtaccgctttgctacgctctttcatcgacgcatctcccgatttgatctattaccgcaacgccaaaggtgagttttctggctgcaaccgagcgatggaagagctgaccggaaagcgcgaaagtgagctagtggggttaacgccttgggatgtttatcgcaaagagattgctcaatcaattgtcgaaacggatcagcaagtttttaacaacaacaccgcgattacttacgagcagtggttggagtacccagatggtcgtaagagcttctttgaactgcgtaaagtgcctttttacaacaaagatggccgccatcttggcttggtcggttttggccgtgatatcaccgagcgtaaacgccatgaagaatcattggagaaagccagccgcgacaaaaccacgtttatttctaccattagccatgagctgcgcactccgctcaatggtatcgttggtttgagccggatgctgctggatactccattgagcggtgagcaacgtaagcatttacaaaccatcaatgttagtgctgtgacgctgggtaatatcttcaacgatattattgatatggataagtttgaccgccgtaaattagagcttttccctgcagccctcaactttgaagagtttgtggcagaaattgaagtgttggcggccttaatggcggagcaaaaagggttacgctttgatttagaacggttaactgacttgccttctttagtggaagtggactcgacacgtctgcgtcaagtgttatggaacctactcagtaacgcgatgaagttcaccaaagagggcggtgtggtgatgacggtcagcgcagaatgcgatgcgcagcatgcagagatcacgattgaagttgaagataccgggattggcattccggaagcggaacaagaaaaaatctttgccatgtattatcaggtcaagtcaggcaaagataacttacatgcggtgggcactggcatcggcttagccgtatcacgtcagttgattaagttgatgggtggcgatatcagcgtcaacagtgaagagggttttggcagcacctttaccgtaacgatccgagtccccttgttagctgaagcgccgattgagattgagccacaggagccgcaaactgagctgaatattttcatggtcgaagacattgagctcaatattacggttgctcgttcattacttgaaagtatggggcataaggtgacggtcgccatgacgggcgaagaagcgatccaaggctttaacccaacagagtacgatctggtgttcctcgatattcagctaccggatatgacaggcttcgatatcgctcactattaccgcacccattactcctcattaccgccattagtggcattaactgccaatgtattgaaggataaagaagagtatcgccaaaaagggatggatgctgcgataagcaagcctttatcggtagcggcggtgcgagaagtgattgcgaagatgacgcaacatcatgccggtgagagcgtcgctaaagtgaaatcaaataaggaaaaagaattaccagacgatctctatcagcagttactggatctcgagatgctgcaatcctatgttgagattgtcggtagccaacccgtgattgatagcgtgcacttattcgaacaatccatgccagcctatcttgctgtattggactcgaatatggtggccaaagatcaagaaggtattgtcagtgaagcccataaaatcaaaggtgcggcaggctctgtcgggttaaaacgcattcaaaagattgctcagaaagcgcaatcgccggaagctcctgcatggtgggagaacatcagtgactgggtggaagagatcaaaaacgaatatcagtctgacattgctttattgaagcgctggctgactcagcaagcaaacgcaaagcagtgataaaaaaagaccctagccattggctagggtcttctctaattagatataaaagaagaggttaatcttctaaatcaccacagaagcggtagccttcaccgtgaatggtggcaatgatttctggcgtacctgacacagattcaaagtgcttacggatacggcggatcgttacatcaacagtacgatcgtgtggtttgagttcacgtccagtcatctttttcaagagatcggcacgagtttgaattttgcccggattttcacagaagtgcagcagagcacggaactcagaacgtggcagcttgtagctatcaccatcagggctcaccagtgaacggctgttgatatccagttcccaaccattaaacacgtatttttcaacgctacgtttttcttcttgtgtggtgcccgcatgcattgagcggctcaacaagttacgtgcgcgaatggttagttcacgtgggttgaaaggcttggtgatgtaatcatctgcgccgatctctaggcccagaatcttatctacttcattgtcgcgaccggtcaggaacatcagcgctacatctgcttgttcacgcagttcgcgtgcaagcagcaggccattttttcctggcaggttgatgtccataatcaccaagttaattggataatcggacagcacttggtgcatctcttcaccattgctggcctcaaaaacagcgtatccctctgcttcaaaaatactcttaagagtgttacgagttacttgctcgtcttcgacgataaggatctgcggggtttgcattagcgttacctaaacttgtgaaaaaatcgtgctagtagaagtcattctaggcaaaaagattacataccggttagtgatgttaacaataaagtaaaaaatctaatttatgtcactactttttgtccgccatccttggtgtaactagtgttgagactcccattctcaagaggttctactagtctatggggcggattctataatgttaacagcatgctaacaacgcccgaatgttaattccaatcactttgttgatttacatcaagagttagaatgtaacagatattaagaacaatcacgagttgtaaaattaccaaatgatcaagattgacgctagcctttggctggcctaccaaagcgtgaaatttgcctttgaaaagccagtaaattggccattttactgcataattaccgcatggaaccctgagagtattcgcttgtcagatgatgagaattgcgtaaataatcaacgtttacagcaatgcttgatcgattatgattgggtgaaagtgagggtaggagacgctcattttcactggtttgaagagagttttgcggtcgtaatgccgctttcagaagcccgaaaattggcgcagagatttgctcaaaacgcgatctattttgtacaagacggcgacctttatctctgttcttgtgttgatgagagcgagcttcatctcgggccaatggggaaacaatagatctgaaaaataaaaatcatggaggaatgatgagagatataaccccagatctttgcgataagtacgaatcgcaagtcactttactcaatttaccgctgcaaaattttggtcaacgcagcgcattttggggcgaaatagtgacagttcgttgctatcacgacaactctaaagtacgtgatgtgctcagccaaaatggcaagggcaaagtattggttgtggatggtcacggttcatgccacaaagccttaatgggtgatcagttggcgattttagccatcaaaaatgattgggaaggcgtaattatttacggcgcagtgcgtgatgtggtcgcaatgtctgagatggatttaggcataaaagcattaggcacaagtccctttaaaaccgaaaagcgcggggcagggcaggtgaatgtcactttgacgatgcaaaatcagatcgttgaaccgggcgattatttgtatgccgattggaatggtattttgatgtcagaaacggcgcttgatgtagcttaaaagcgaaaaccgacaccaaactcgacggcttgctgccattcttggtagtccagcgtggcatgcaagtcgagattttcggttaattttaatcggctcgacaattcggcggataccacggcttcttggtttttactttccaccttgggtgaggcaattaaggtgcttttgaacgagagacgttcggtaaattgatagccaatgccactcagccaaccctgtgctccattatccaatcgattatgaatgcgagcaccgacatacagatcgatatcgttaaacaggttgtaagcgtaaccaccatcaatcgtccaactatcaaagctttggctgctgttatcgctggcaataaataatttgtgcggcgaggcattgctctctgagggcaaggcaggaagcagctctgctccggcaaatggagccactaaggttatcaaacagaaaaaagcagttttcacgatagccccggatgtaccagccaagattgataggtacgctcaatttaagcataaaaacacatacattccacaaagagttttatagcattttgttatttctatataggcagattgttggtggcttgctatctggttgtgccgattgaaaaactcatgatgaccccctagatgaatgcgcagattaagttgtggcgttattgacgaggctcgtccttttaatcacagcatcagcctattttgagcgtgatacactcactagttgcccacttatcacctcaagttgtttgagtatgcacagtcgaagatttttaaaatcctcaataaaaaaagcagattttcgttgacgacttgaacgcaaatgagttaaacgtatttgcaagcaaacacacagatagacagaaaaaccgttatgttgaatcacagcctaatcgtaatgaccaccattattaccattaccgacacgtcgcatgttggggcaggctgctgagcgcaaaatttcacaaaaaaggcctgtatcccaaccgatacaggcctttttttatacccgctttttatgcatttggaggaagggatgcgagtattaaagtttggaggttcatcgctggcggatccggagcgttttctacgcgctgccgatatcatcgcgaataacgcacagcaggaagaggtggccgttgtcctctctgctccgggaaaaaccaccaataaattggtggcagtgattgaaagtgctttacgtcagggagaggtggaagcgcaaatcgtagagctagagagctcattctatgccttgcttgatggcattaaagcgcagctcccgaatttggatgacagtgcttatcaacagcaagtgcactcttccatgactcagttacgccagtttgtgcatggcattacgttgctcggtatgtgtccagacaatgtgaatgcacgcattatcagtaaaggtgaacgcgtttccattcaattgatgaaagcggtgatggaagccaaaggtctgccagcgaatttggttgaccccgttaaatacctgcttgccaaaggggatcatcttgaagctatggtcgatgtggaaatctcgactcagcgtttcagacaagcaccattgccacaacagcacgtcaatatcatgccgggctttactgcgggtaatgcacagggtgagttggtctgtttagggcgtaacggttcggattactcagccgcagtactggctgcctgtttacgtgcggattgttgtgaaatctggacggatgtggatggagtttataactgcgatccgcgtttggtcgatgatgcgcgtcttttgaaatcccttagctatcaagaggcgatggagctttcttacttcggagcatctgtgttgcatccgaagaccattgcaccgattgctcaatttcaaatcccttgcctgatcaaaaacagcttcaatccacaaggtgcgggcaccttgattggccaagacactggcgaagataaactcgcgatcaaaggcattaccactctgagcaatctgaccatggtcaacgtttctggtccaggaatgaaaggcatggtggggatggcgagccgcgtgtttggcgcgatgtcagcggcagatgtgtcgatcgtgctcattactcaatcttcttcggaatacagcatcagtttctgtatcgaagcacaacataaagctttggcacagcaagcgctggcggatgcatttgaactggaactcaaagatggcctgcttgagccggttgagtttgtcgataacgtcgccatcatcacgctggttggtgatggtatgcgtacctctcgcggtgtcgcgtcgcaatttttctcatctctggccgaagtacacgtcaacgtgattgcgattgcccaaggctcttctgagcgtgcgatttcagcggtgatccccgatgataagatttcagaagcgatcaaggcctgtcacgaaaacctcttcaactctaaacactttttagatgtgtttgtggtcggtgttggtggcgtgggcggtgagttggtggatcaaattcagcgtcaacaagccaagcttgcggaaaaaggcatcatgatgcgcgtttgtggcctcgctaacagtaaaggcatgctgcttgatagccaaggcttgccgttagagcagtggcgcgatcgtatgatcaatgcggatcaagcgttcagtttagagaatctggtggctttggtgcagcgtaatcacatcattaacccagtattggtggattgcacgtccagtgatgagattgctaaccagtatgcggatttcctcgccgcgggtttccatgtggtgaccccgaacaagaaagccaataccgctagcatgagttattaccatcagctacgtaatgtggctcgtcattcgcgtcgcaaactgatgtatgaaactacagttggcgcgggtctacccgttatcgaaaacttgcaaaacctaattgcagcaggggatgagctggaaaaattcagcggtattctctcaggttctctctcctttatcttcggtaaattggatgaaggcatgaccttgagccaagcaacgcagcttgctaaagagaaaggctttacagagccagatccgcgcgatgatctctctggtatggatgtggcgcgcaagttactgattttggcgcgtgaagcagggtacgaattggagctgagcgatgtggatgttgaacaagcactgcccgctggctttgatgcttcaggcagtgttgaggagttcatggctcgtttagcgcaagccgatgccgcgtttgccgagcgagtggcgcaagccaaagccgaaggcaaagtgcttcgctatgtggcgcaaatcgtcgatggccagtgccaagtgcggattgtcgcggttgatgaaaacgatcctatgttcaaagtcaaagaaggtgaaaacgcgctggctttctacagccgttactatcagccaatcccattggtattacgtggttacggcgcgggttctgaagtgactgctgcaggcgtgttctcagatgtgatgcgtacactcggttggaaattaggggtttaatagaaatgagttcaggtgacatgagtgttgtggtgtacgcacccgcttccattggtaatgtcagtgtcgggtttgatgtgttgggggccgcagtgtccccgattgatggcacgttactcggcgatcgagtgaaagtggaagctggcgcagaggctttcacactgaaaacggcggggcgatttgtcgataagcttcccgctaatccgcaagaaaacattgtgtatgactgctggcaagtattcgcgcgtgagctagagaaaaagtcggtggtactgaagccgctgaccatgacgctagaaaaaaatatgccgattggttcaggattgggctccagtgcttgctcgattgtcgcggctctggatgcgttgaatcagtttcacgccagtccgcttgatgaaactgagcttctggctctgatgggggaaatggaaggcaagatctctggcagtattcactatgacaacgttgctccctgctatttaggtggtgtgcagctcatgctggaagagcttggcatcatcagtcaatccgtaccgagttttgatgactggtattgggtgatggcctatccggggatcaaggtgtccacggcggaagcgcgtgccattttgcctgcgcagtatcgccgccaagatatcgtggcgcatggccgctatctggcaggatttattcacgcttgccatactcagcagcctgaattagcggcaaaaatgatcaaagacgtgattgccgaaccctatcgtgagaaactgctgccgggttttgctaaagcgcgcaactacgccgcttcggctggcgcactggcaacgggcatttcgggcagtggtccgactttgtttagcgtgtgcaaagaacaagcagtggctgaacgtgtggcacgttggcttgagcaaaactatgtgcaaaatgaagaaggattcgtccacatttgtcgtctagacaagcaaggttcgaaagtaacaggaagtgagctatgaagctgtacaacataaaagaaaatgatgaacaagtctcctttggtcaagccgttcgccaagggttaggccgcaatcaaggcctgctttttccggcacaattgccgaagtttgacgatattgatgctctattggccgaagatttcgtctctcgtagcagcaagattttatcggcgttgattggcgatgaactgcctgcggataaaattcgcgctatggtggattccgcctttcaattcgccgcaccgattgccaaagtgaaagagggcgtttacgcgctcgaattgttccacgggccaacgctcgcgtttaaagattttggtggtcgctttatggcccagtctctggcggcggtctcgaacggcggaaaaatcacgattttgacggcgacatccggtgataccggcgctgctgttgcgcacgcattttatggtatgccagacattaatgtggtgatcctttatccgaaaggaaaaatcagtccgctgcaagaaaagctgttctgcacattaggtaaaaacattcacaccgtggcgatcaatggcgattttgatgcttgccaagcactagtgaaacaagcttttgatgacgcagagctgcgccaacagataggtttgaactctgccaactcaattaacatcagccgtttgatggcacaaatctgttactactttgaagccgctgcgcagatgagcaaagctgagcgtgaaaatctggtgatttcagtgcctagtggcaactttggtaacttaaccgcagggctgttagccaaagcactgggtttaccggtgaagcgctttattgcggcaaccaatgccaacgatacagtgccacgttacttggaaacgggacgttgggaacccaaacccacggtagcaacaacgtcaaatgcgatggatgtcagccaaccgaacaactggccgcgtatcgaagagctctgccaacgtatgggatggggcttagaaacgctgggcaaaggcgcggtttctgacgaggaaagtgcgcaagccgtacaagaactttacgatctaggctacttgtgtgaaccgcatggttcgattgcttaccgtgtattggaagagcagcgccagccgcaagaaacggggctgttcttatgtaccgcgcatcccgccaaattcaaagaagtggtggacgatattttaggtaccgacattgctctaccagcgccattggcaaaacatgcggcgatggaattgctctcacaagagctgaatgccgatttcgcagcgctgcgtgcgttactggtgaatgtgaaataattcgcggatttgagaaagcgaagataataaaaaacggtgctcattgagcaccgttttagtatggactctttactgacgattacagagattcagtgaaagtacgcgcgataacgtcgcgttgctgctcagcagtcagagagttgaaacgcacggcgtagccagaaacacggatagtcagctgtgggtatttttctggatgcgcaacggcatcttccagagtttcacgcttcagtacgtttacgttcaaatgttgaccaccttcgatacgtggtgccgcttcgatagccacttcacggctttcgaattgaccaagatcgttgatgctaaccacttgatcagcttcaaagcctttcagcgcagcaacacagcgtgcttcattcttttcgctatctagcaaccagatagagttcagtaggtcgtcgttagcagctttagtgatttggataccttggatcatcgctttctcctagtccacatcaagtggcgttattggtgttaattttcagatcttgttgagctggctattatatagcaaatatccatactgctgatattgatttaggtcaaattacaacaaaaaaccatttttatactggggtttggtttttgatttgtgtcaataaatgctttaaaaacaatgatgattaaatttattttaaataataaaaaatagttaagttgtattttgttgtaattttactacaaaattgtaatccaacttgacccgtgccagagaaaatcagaaagttagcgctgtgaactgaaagtccgaagtcatttagcaacaataagaagtcgtaatatgtatgagaagttaatcggggcacatgtatcggcctctggtggtgtcgaactcgcgccagttcgagctcatgaaatcggagcgaatgcttttgctctcttcaccaaaaaccagcgccaatgggcagctaagccactggaagcgagcagcattcgtgctttcaaagccaattgtaaaaaatggggatttggcagtgaggcgattttgccgcacgactcttatctgattaatttaggggctccagaacccgagaagctcgacaaatcacgagccgcttttgtcgatgaaatgctgcgttgtgatcagttagggttaactttgcttaactttcatcccggtagtcatttacagcaggtctctgaagaggcgtgtttagcgacaattgctgagtcaattaatcttgcgcatcgtcaagtaccgaatgtgattgcggtgattgaaaataccgcagggcaggggagtaacttaggttggcgttttgagcatctggcggcaatcattgaccaagttgaggataaagagcgggttggcgtatgcctagatacttgccacacctttgccgcagggtatgatttgcgtacgaaagccgcgtgtgatgagacattcgctgagtttgagcgagtggtcggtatgcactatttgcgcgcaatgcacatcaatgattcaaaaggtaagctggctagccgcgttgaccgccatcattccttaggtatgggagagattggctgggagtgttttgaatatatcgcgcaagatgctcgatttaacggtatccctctgattttagaaacgattgatcctgacatttgggcgactgagatcgcaacgctacgcaaattttcgacgcaaaaagagaattaatcggcaaacttcacagatttggcatctttctttcatcatgctcagggtcagcgttgtaagaaggatgccgctatgaactcattaactcaaactgcttcacccagttccagacccgccgctcgtcgcccggttcctaatcgacacgtcaatgggcaagggcatcatcgtgctccacagccgcaaaaaccgcattaagataacaaaaaccgtattcagatgaatggctaagcaacctctctctttaacaggagagcgaggttgccttccgcttgtgaatattgaagtcggtgcacttattttcgcttagctgcaactgagcgtggtttgggtatacaatgccaacagaaatcataatttaaggtattgatatgtctgaatcactgacgtggcatgatgtcattggtaatgaaaagcagcaggcttactttcaacaaactctgcaatttgtcgaaagccagcgtcaagccggaaaagttatctatcctcccgctaaagatgtgtttaacgcctttcgctttaccgagtttggtgacgtgaaagtggtgatcttggggcaagatccttatcacggccctaatcaggcgcatggtttgtgtttctctgtgctaccgggtgtcaaaacaccgccctcgttagtcaatatttataaagagttagcgcaagatatccctggatttcaaatcccacctcatggctacctacaaagttgggcacagcagggcgttttgctactcaacaccgtattgactgttgaacaaggtatggcccattctcatgcgaataccggctgggaaaccttcacggatcgtgtgattgacgccttgaatcaacaccgaaatgggttgatcttcctattgtggggatcgcacgcgcagaaaaagggccagatgatcgatcgccagcgccatcatgtcttgatggctccgcacccttcaccgctttcggcgcacaggggctttttaggatgtcggcatttctctaaaaccaatcaattgctgcaagcgcaaggtatcgctcccattaactggcagcccgagctcgaatcttaatgcaattggcgttttttcgaccagtttcaaagccgatatatcaatccttatgtacactttaccttagtacaagtatggagattgataagatgatgatggaacgaatccgccgcgagcacagttatatggtgcgtttgttgtcgattttacgccacaaattggatctggtgaaaagcgagcaaccgatcaactacagccttctgaaagaaatcgttgattatttagcaagccattcagagaaagtgcatcacccgaaagaggacattctgtaccgccactacatggcacattacggcgatgaacagcaagtggctaatttggagcgtgaacatcaagagttggcgcaaattacccatcagtttctcgatgtcatggagatgattttaaacgatgcggttgtgccacaagatgtgtttattgagcaactggaggcctttctacaaggtcaaaaacagcatttagagttggaagaacaatcgattttgccattgattaatcaaacgtttgaattagaagattggcagaacgttgagtcgcaatggcaaaacaacgatgatgatccggtattcggtgaaacgatcgctgagcgatatgcgcttttggctcgccgtgttcgtaaaagtgagagtgaatacacctaaccaatcaaaggtataccatgcaggattgcttcagtttcacatgacactgcgttgtctagagaagcttgctgtggatagccgttctcacttaaagtcttaaaaacaacaaaggcacgcgaaacgtgcctttgttgctcaatcctttaaatttttatgtcgtcagcgtcgagacaaacatccatatccaacaactctttctctagtcgtttacgatctcgaatcgcttcgatctcgcgccacatccgttttacaggtttagaacggctagtacgaattttcgagatttccatttccaacagctcatcaaagtgcagttcgtccataagtcgcctcattattgttgtcatcattccttgagtgctctctaaatagcacaccttggcgaagcgtaactatgatttgtttctcatttgtttcgttttaatgaagctttagtgagcttttgaatagaatttcacagttttcaccctgagttatcgatggaaaactgaacaaaaaattgaggcaatcgattaactggacgatttttttgtgttgctgaaatgttgttttttacgttgcacggaattgtgttggttgttttttgtgcgaacaaacaggaaatatgacactctcctgacaaaatttactggttcgcacaggcatgctgcgattcccaaagcgtgagatttcattaatgcaacaaagcatttgtggtgaataaatgtactgatctgtgtgctttttgttttctttttgttctttgtttgtgactcaaatggttttgttgatgttaataaagcgtgattttaaggtgaaaaataacattttaatgcaatcctgttcatattgatttttgcggattgaggttgcattatccgcccgtcaaaaaataggctgggtgcttttcgaggtctcttctgctcgagagtgccatgacatacacggcaaaaagataatctcaataccgtatccgtgtaacagaaactcttactcatcggagtcagagcagctcatcactctatgcgaggttcctgtgacagacttaattaatttaatgaatgacctactatggggttccatcttggtatacctattggtcggggtcggtatctacttcactttgcgattgggttttatccaatttcgtcatttcacccacacttttaccgtcctcaaaaatagccgtaaagcggataacgctggcatctcctctttccaagcgttatgtaccagccttgccgcacgtgtcggtacggggaacatggccggggtggcggttgctttaaccgctggtggtcctggcgccatcttctggatgtggttgattgccatgttaggcatggcgacttctttcgctgaaagtaccctagctcagttgtataaaacgcgtgacaaagatggcaattaccgcggcggtccagcgtattacatggaaaaaggccttggtatgcgttggatgggggtgctgttctccatcttcctgatcattgcgtttggtttggtgtttaacgcggtgcaagccaactcaatcaccaatgcgatgaaaacggctttcggttttgaacccatgctgatcggtattggtatcgtgttgctgaccgctttcgtgatttttggtggcatccgtaagattgcacggacggcagagctgattgtgcctttcatggcgtttgcttatctggcgattgctctgtttgtcgtggtcatgaattatgagaaagtgcctgatgcgattagcctgattttcaaaagtgccttcggtttacaagaagcggctgcaggtggcctaggctatgcgattgcacaagctatgatcaacggtgtgaaacgtggcttgttctcaaacgaagcgggtatgggttctgcacctaacgccgcggcttctgcaacgccatatccaccacacccagcttcacaaggttacgtgcaaatgcttggtgtgttcatcgatacgattgtgatctgtaccgcgacagtggcgattatccttatgtctggtgagtatgtaccgcacggcgagttaacgggtattgagctgactcagcgtgcactcagttcacaagtaggggattggggaggtatctttatcgcatttgcgatcttcttcttcgcttttacttcgatcatcgccaactactcgtatgcggaaaccaacctgattttccttgagcacaacaataagaaaggcttagtgctgtttcgtctcgtgttcttaggtatggtgatgtttggctcgttggcaacattgccaacggtgtgggcgatggcggatgtctcgatgggcttgatggcgattgtgaacttggtcgctatcctcctgctctcaggtatcgtgattaaactggcgaaagattacaaccgtcagctggatgctggcaaagtaccgacctttgatgccaatgattacccagagttgaaatctcagcttgaagatggcatttgggataacaacaaagcgtcatagacagcgccgatgtcagaaattgaaaaagccatgcagacaccgcatggctttttttgtaccctagcttgcgtcatcttataaaaaatttaatcacttggaataatggccagtgctgtcgtttcaagtcggttgataacacgctcaacaaaagataggaattattatgctgattgtcgtttcacctgcgaaaacgctggattatgaatctcccgtttcaacctcaaactttacgcagcctgaattaaccgcgcattcggcagagttaattcaagtctgtcgtactttgtcatcacaggatgtttctgagctgatgagtgtcagcgataaaattgccggactcaatgtggctcgatttgcgcagtggagtgaaaccttcactctcgataacgcacgacaggcgattttcgctttcaaaggtgatgtgtacactgggctggaagcggaaacactctcgccacaagatttggattttgcccagcaacatctacgtatgctctctggcttgtatggcgtgttgcgcccgctggatttgatgcaaccttatcgcctagaaatgggaacaaaattagccaacgcgcgtggtgcgaatctgtatcagttttggggggacattattacagagaagctcaatcaagcgattgaagcacaaggtgataatgtactggtaaaccttgcctctaatgagtatttcaaagcggtcaatccgaagcgattgaacgcgcaaattgtgacgccaatctttaaagatgccaaaaatggccaatataaaatcatcagcttctttgcgaagaaagcacgcggcatgatggctcgctacatcattgaaaatcgaattaaatcggtaaaggatttagaaggtttcaacactgcgggctactattttgtggcaagtgaatcaacacccaccgagttggtgtttaagcgcgaagagcaataacctccaaggttcaaaataaggaacacatgatgtggctatggttaaaacgttggattgcgaaatacgatgcttggtgccaaagcatggggttaatgccggggcaaaagcgcagttgtgttccttatcgaaaagatccggccaatgaacgagacgattccacctccgcttgaatggtcgttgttcgacacccattgccactttgattttcctccgtttactgccacccctgagctggaattgcaaaaagcggcgcagcatggagttaggcggctcgttgtgccatcgattgggccgcaagattggcaggcggtgactgagctggcgcagcgctttccctcaaccatttactatgcgttgggatttcatccactctatttagatgcctcttcaccgacccatttacctgcgttagaaaaggctctaatgcaggcagaacaggcttgtgtagccgttggggagtgcggtttagatggcatgatagacgtcgatgtggcgctacaagagcagatgctgatcgcccagctctctatggcctcacaggccaaactacccgtgatcctgcatagccgacgtactcacaatcggttgttacagttattgaaacagcagcgttttcaacaaggtggtgtgctgcatgctttttctggcagtgtgcaagaagcgcagcagtttgtagacctagggtttaagattggtgtgggaggcgtcatcacttacccaagagccaataaaactcggcaagccatcgcagcgttacctgtagagcacatagtgttagagacggacgcgcctgatatgccactgaatggttttcaaggtcaggctaaccatccggctcaattagccaaggttttagaaacactcgccgagctaaaaggtgtttcagcacaatatctcgcgccaatcctctggcaaaacagtcaaatgctgtttggcttgtgtgaacaaaaccgaaacaagatgtagcgttaatgacgcatctgtcactaaaagttgagtggtgtcacagatattagtgaacgcgtgatgaatcttatccgaaagtgtgaatcctgcattactttctctctgtgcccgtgagtataattgcccccgcttaatcgctccattttgtaacacgccaacattaaactaataaggaagtcataaactatgagcctgtttatgagcctcatcggcatggcagttctgctaggaatcgcagttctactgtcaagtaaccgtaaagctatcaatctaagaactgtgggtggcgcttttgctatccaattttcactgggtgcatttattctgtatgtgccttggggccaagagctacttcgtggcttttcggatgccgtatcgaatgttattaactacggtaacgatggtacttcattcctcttcggtggactggtatcaggcaaaatgtttgaagtgtttggcggcggcggtttcattttcgcattccgcgtactaccaacactgatcttcttctcagcactgatttctgtactgtactacttgggtgttatgcaatgggttatccgcattcttggcggtggtctgcaaaaagcactgggtacatcacgcgcggaatctatgtctgcggctgcaaacattttcgtgggtcaaactgaagcaccattagttgttcgtccattcgttccaaaaatgactcaatctgagctgtttgcggtaatgtgtggtggcttggcttctatcgcaggtggtgtacttgcgggttacgcttcaatgggcgttaagatcgaatacttggtagcggcgtcattcatggcggcaccgggtggtctgctgttcgcaaaactgatgatgcctgaaactgaaaaaccacaagacaatgaagacattactcttgatggtggtgacgacaaaccggctaacgttatcgatgcggctgctggcggtgcttctgctggtctgcaacttgctctgaacgttggtgcaatgttgattgcctttatcggtttgattgctctgatcaacggtatgttgggtggcatcggtggttggttcggtatgcctgaactgaaactggaaatgctactgggctggttgtttgcgcctctggctttcctgatcggtgttccttggaacgaagcaactgttgcgggtgagttcatcggtctaaaaaccgttgctaacgaattcgttgcttactctcagtttgcgccttacctgactgaagcggcaccagtggttctgtctgagaaaaccaaagcgatcatctctttcgctctgtgtggttttgcgaacctttcttctatcgcaattctgcttggtggtttgggtagcttggcacctaagcgtcgtggcgacatcgctcgtatgggggtcaaagcggttatcgcaggtactctatctaacctgatggcagcgaccatcgctggcttcttcctctctttctaattcatagagacagagctttatagacgccgtttaaattcaccccgtagcaagtgattgctgcggggtgttttgcttttaggcgccccgagttttagggggagacctaggggtaatgttgtaatggattgcagagctgaagccttgtgtggtaagggattgccctttaaatttcagctatttttttgagatacaaaccgtttgcgcttcgcgcagcactaccgctttgcgacaaatatctatactgtagccatggataaaaaacgagtggattgacgatggaatacaccacgcgtttgaccgtgagcttaggctcaggtggcgggcttatctaatggaatatggatgagttttcgctggctctcagcatgactaagagtatgatgagcgccggaggcaatcgccttgcctgtatgcagtaaaataccgcaaacgcagattgttgtgccattgaccaaactggtactgtgcggtgacaaggatagcaattggtgcatgagcaccgagtcttcaaggaaccaagtccgttcatttgtggctgctcagcagaaaatagtactctgctggggagtgaactagatgactatattgatcggagatagaaatgagcgaattaaaagtagcagctctacgtgcactgaaactgatggatctcaccacgttgaatgacaacgatacggatgccaaagtgatccaactttgtcatgatgcgaaaagtccagtcggcaacacggctgccatttgtatttaccctcgctttattcctattgctaagaagacacttcgcgagcaaggaacccctgaaatccgtattgctacggtaaccaattttcctcacggtaatgacgatattgaaatcgccgttgctgaaacgaaagccgctgttgcttacggtgctgatgaagtggatgtggtattcccatatcgcgctctgatcgcaggcaacgagcaagtcggttttgatctggtgaaacagtgtaaagcggcttgtggcgacaaagtgctactgaaagtgatcatcgaaactggtgagctgaaacaagaagcgctgatcaaaaaagcctctcaaatctgtattgaagctggcgcagatttcatcaagacctcaaccggcaaagtgccagtaaatgcgacaccagaatatgcacgcatgatgctggaagtgatccgtgatatgggcgtagccaaaaccgtcggtttcaaacctgccggtggtgttcgtaccgcagaagatgcgcagcaatatctggccatggccgatgagatcctcggtggcgattgggcagacagccgtcactaccgtttcggcgcttcaagcctactgactaaccttctgaatacattagaagtgacagaccaaaaggcagatcctgccgcttactaatatccattgtgtctgagagcagcgcgaggcttcgcgctgcttaacctctttacactacgcagtttctttgggaactgggaggcagctatgtctttatctcaagcaaagtatttacctcaagaaattatccgcagaaagcgtgatggtgaagttctcaccaacgatgaaatcaacttcttcattcaaggtgtggcgaataacaccgtctctgaagggcaaattgccgcgtttgcgatggcgatttttttccgtgaaatgactatgcctgagcgtattgcactgacgtgcgcgatgcgcgattccggtatggtgattgattggagccacatgaattttgatggtccgattgtggataaacactccacgggcggcgtgggcgatgtgacctcactgatgcttggccctatggtggcagcctgtggcggttatgtgccgatgatttctggccgcggccttggtcacactggggggacgctcgacaaacttgaagccatccccggctacaacattaccccaaccaatgacgtgtttggcaaagtgaccaaacaagccggcgtggcgatcatcggccaaacaggtgatctggctccggcggataagcgtgtgtacgcaacgcgtgatattaccgcgacagtggataacatctcgctgatcaccgcttcaattctttctaagaaactggcggctggccttgaatcgctcgtgatggatgtgaaagttggctctggtgctttcatgccaacttacgaagcgtctgaagagctcgccaaatcgatcgtggcagtggccaacggtgcaggcaccaataccacggcgattttaaccgatatgaaccaagtgctggcgtcctctgctggtaacgcggtggaagtgcgtgaagcagtacgcttcctcaccggcgaataccgcaatccgcgtctactggaagtcactatggcgtcgtgtgcggaaatgctggtacttggcaagttagccaaagatactgcgcaagcgcgtgagaaactgcaagcagtgctggataacggccaagccgccgatcgttttggcaaaatggtcgcaggcctcggtggcccaagcgattttgttgaaaactacgacaagtatcttgcgaaagctgagattattcgcccagtttacgctcagcaatctggcgttatttctgcgatggatacccgtgccatcggtatggcggtggtcggcatgggcggtggccgccgcgtggcgaccgatcgcatcgattacgctgtcggctttgatcagtttatccgtctgggtgaaatcgccgacagcaacaaacctttagcaatgattcatgcccgcaatgaagagcagtggcaacaagctgccaatgcactacaaagtgcgattaaagtgggcggtgattacctaccaacaccggatgtttaccgtcaaattcgagcacaagacgtgtaagttcgggggagtgagcaatgaaaagagcatttattttagttttagactcgtttggcattggcgcaacagcggatgcacaagcctttggtgatgtgggttctgataccttaggccacatcgcggatcaatgtgcgcaaggtttggcggataacgcagaacgtaaaggcgcattgcaactgccgaatctttctaagctgggtttggcgatggcgcataaagagtcgacgggacgttttgcgccggggctggatgagcgtgcggatatcatcggcgcttatgcccatgccgcagagctgtcatctggcaaagatactccgtcaggtcactgggaaattgctggtgtgccagtgctgtttgaatggggttactttagcgataagcaaaatagcttcccgaaagagctgaccgatcgcattttagcgcgcgcgggtctggacggatttttaggcaactgccacgcctctggtacgcaagtgctggatgatttgggcgaagagcatatgcgtacgggcaagccgattttctacacctcggcagattctgtattccaaattgcctgccacgaagagacatttggtttagatcgtctgctggagctgtgccaaatcgctcgtgaagagctggcggattacaacatcggtcgcgtcattgcgcgtccattcgttggcccgggcaaaggacaatttgcccgtaccggtaatcgccgtgacttgtcggttgagccaccttcagccacagtgttgcaaaagttggtcgaagagaagcaaggtcgagtggtctctatcggtaaaattgccgatatctacgcgtactgcggcattaccgacaaagtcaaagcgacgggcattccagatctgtttgaagcgactttagagcagattaaacaagccggtgataacaccatcgtattcactaactttgtggattttgactcggcttatggtcaccgccgtgatgtcgcaggttatgcggcggcattggagtatttcgataagcgtttacctgaagttctggagttgatgcaggaagatgacattctgattttaactgccgaccacggctgtgacccaacatggccgggcactgaccatactcgtgaacacattccggtactggtttatggcaagaaagtggctccgggttcattaggtcgtcgtgacacttttgctgatatcgggcaaactctggcaagctactttggcacttcgccaatggattacggtaagaactttttataatacgcataccctaaggctagcttcagtcttagggttttgttgaatgatggcgattgagccaacaaaccaaaggaacgaaaacatggcaactccacatattaatgcgcaaatgggtgatttcgctgacgttgtactgatgccgggtgatccgctgcgcgcgaaatacatcgcagaaaacttcctcgataacgcagttcaagtatgtgatgtgcgcaatatgttcggctacacaggcacttacaaaggccgcaagatctctgtgatggggcatggtatgggtatcccatcttgctcaatctatgtaaccgagcttatcaaagattacggcgtgaaaaagatcatccgcgtcggtagctgtggtgcagtgaacgaaggcatcaaagtgcgtgatgtggtgatcggtatgggcgcgtgtactgactctaaagtcaaccgtattcgcttcaaagatcatgattttgctgcgattgcggattacaagatggtaaaggctgcagaagaagcggccaaagctcgtggcattgacgtgaaagttggcaacctgttctctgcagaactgttctacacgccagatccttccatgttcgatgtgatggataaatacggcatcgttggcgtagaaatggaagcggcaggcatttacggtgtagcggcggaatacggcgcgaaagcactggcgatctgtactgtgtctgaccacatcaaaacgggcgagcaaaccacctcagaagagcgtcaaaacaccttcaatgagatgattgaaatcgcactggactctgtactgattggtgatcaagcgggttattaatctctgtattagtgttatccctgaataaaaaacctcagcctgtgctgaggtttttttatcactgaagaacgtattcaaatcagtcattcaaagattgttcggcttgcttgagcaacagattttcacctgtcggctttttcggtctgcgttgcaacaatagggtaagcaaaataccactgacaaagctcatcagtagcatccaatacatgttgtgatcgctcttgcgataatggtggtcagaaattgccgtcactttgcctgtttcaaacgtgatgcgtacaaaaccaatcaaacttccgtcatgaaccacaggttctactaattgctgacgcccaatacttgcggtgtgcagtggtgtatccaaccctaacacttcacgaacacttaatgcagactcgctcgccgccagcagtacgccctcagagtcatagattgaagcatcaaataccagtcgatcggtcgcgagttggttagttagtgctaacaaacgttcctgatcttgatcggcgatcatactgcctgcagacattgctgcttgagtgatcagcactttggttaaggtttcaagttggttagcttgaatacgctcgttacctttactgatcaccacgctattttgaatcgtgataaaaaacatcacggcaactgctagcacagttgcaacgcgtaccactactcggaatgaaaaaagtgagccatccatgtcgaaggaaacctgcaaaaaaccaactgcgctcatattgagacttgcgtttttaaattgcaatagggtaacgtctggctataccgaataaggaaagtggacatggatgctttaacaactttaccgatcaaaaaacacacagcgctactcaaccgttttcctgaaacgcgttttgtcacccaattagcgaaaaaacgtgccagttggattgtgtttggacattacctaactcccgctcaatttgaagacatggatttcttcaccaatcgcttcaatgccatcttagatatgtggaaagtgggacgttatgaagtcgcattgatggacggtgagctgacgtctgagcatgaaactattcttaaagcgttagaactcgattacgcgcggattcaggatgtgcccgatctcaccaagccggggttaattgtgctggatatggactcgaccgcgatccagatcgaatgcattgatgaaattgctaagcttgcgggagtcggggaagaggtcgctgaagtcactgagcgcgcgatgcaaggtgagctggattttgagcagagtttacgtttacgagtcagtaaacttaaagatgctccggagcagatcctaagccaagtacgcgaaaccctgccgttaatgcctgaattacccgagctggtggcgacgctgcatgcctttggttggaaagttgcgatcgcctcgggtggctttacctacttctctgattatctcaaagagcagttgtcgctagactatgcacagtccaacactctagaaattgtgagcggcaaactgactggacaggtgctgggagaggtagtctccgcgcaaaccaaagccgatattttgctgacgcttgctcagcaatacgatgtggaaattcataacacggtagcggttggcgatggcgcaaatgatttggtgatgatggcggcagcagggcttggggtggcataccatgccaaacctaaggttgaagccaaggcgcaaacggcggtgcgttttgcaggattaggtggcgtcgtgtgtatcctttctgccgcactggtcgctcagcaaaaactgagttggaaaagtaagccttagcccgcacttagaacttaggttaatcaaataagccacgttcagtgacgtggcttatgtttggaagagatatacccttcctacttgaagctgcacgagtgttggctacgttcgttcaccccaatcacatagtctgtctatgctcatggggattcactcacttgccgcctacctgcaactccaagtggtttgggtatagcgctagtatcaggtcaactcaagtcggatcaacacttcctcagtaatatcgaccaattcaccatagccgacttgtgccagcatctctttttctaaacttttggcgtggtgtgggctgatctcagccagctcggtcaaatcgctgcgtagcaaattcgtgatcggtgcaaacaccggaacaccactcaccctgagtgcgtagaattcgcccatcgcttgcccttggcggataaaacggatgcgttcacgagtatcggcaaagtcactcaacaaacgtgattccacggattgaatgcgtgttccgtatttcaccgcactcaaatacacctcatggtattgcggtaccgcgccttcaatccgtttcattggcgttgcgagtaacgagttggtatgccccttaaatattggttgcagagtaattcgattctcactacccaatttggccaacagcgccagatgtggtgggagtgggtagttcaccccaatcactttgggtttaagattactcccgaccttttcaacaaaaaacggcgtactcaccatcttatcgagcagaatattatgcagactttcgagtagggcattgctcggtagtatctcttctttaatcaatagtttgtcttggttgtgttcaatgatgctattaaagaaagcaatggttttgagggtttgtaaattctcctcaataaccagttgtaaacggcgtccttcaggaccgatacgcaccactttgtagggggccttgtctaagggaaggcttttgtcgtacaacttgagctcaaggtaatcgacccagacttgatcgttggctttgacatccagtggggtatctaacagcaaactgagaccacgcttagagagatcaaccgttgctcccgtgaccttgagtgcatctatgctcacttgtactggcgtactaaaccgataacgcggctctttgcgccgtgagcgcgcatcaaaatagatacccatcggtgtaccgacgacctgacgtgggtggcggaagtcattcagtgcgctgctcggtaaattgggtttttcaaccagtaaatagtcgtgtgccgcttcagtatcactgatctcttgcagtacaccgcaatgagtgagagaacgggattggtcagctaattcacgagagtgttcggcgagcgtttttcgctcttcatcggagagttcaaacacaaacagtcgaaacgctttccagctatcgcgtttagcgccaatatgccaaaacagcttgcgctgttcttgagtcgcctctggcatcagcatagagaaaaacaaagtcttgtgttggtgctcatgcttaaaggcgtacaacacattattgctgccccgaacgcccggagcggttaagtgcgccatgcgttctggtttgaataaggtgccaagtgcttgctggttacgctcatcgtgccaatattgccaaatggggcggttattctcggtgagtaacgccagcttgagttcgttgccactaaaaaacagcggtagattacaggtgtgtttgaggtacatgtgctcatagccacgagtacgggcacgaatgatcttatcttggttgtcgtggcgtgctttctgcgtattagtctgaatcgcttcctcgatgactttttcaatcacatcggtatcactgagtttcaatacccgcagaaatttaatcgcatcactgtcataggactcatcgacgccgagaatccggtaatcgatacttttatgcagtcccaccacgtttgaggttttatttaagtcagaaaaatagacttgaatcacctcgcccaatttgtagtcaaatgctgctggcacttttaatttggccccagaaggggagaggtcaacactcagaccgtgtactaattgctcgttcttcagatggatttcgatctggctggagatttttaagcggttttcttggcgtttgaggtcgtatccaagcttgaccggctcaacttcaaaactcgtatctttcggctgatctgttttcggatcgagtttgccttgttgcttcatgactcggaaattattgcgggtgttattgaccgcttcccacaccccttcggtataagccccaaatttcttgagacttttttggtaagagttgaacgccacatcatcaagccagtgttggcggccatcaaaatggtattcccgacactctccttgaactttgccacgtaaatcaatgctttttgtacaaggtgccattaggcggttcagttccattttgaccaataatttggccgaaggcgggtgcccttcggtcatttgcgacaaaaggtagtcaaggtcaccggaacgataaacgggtataagcctttcaaccagagagagaatttcggtctgttgcatacttttctgttaaagtgtcttccattctgatgcatcggcatcaacatactaatctttagcgatatgttgcagccgttccactttttcttaaagtattacgcctgataagtgagagcaagttcgaggattgattgtgaaagctaagcgcgcctatgtatgtaatgaatgtggagcggattttccgcgttggcaaggacagtgtaatgcctgtggttcgtggaattcgatttcagaagttcgtttagcggcttcaccgcaagtggcgcgcaatgaaaggttggtcggttatgcgggagcccttgaagcgaaagtacaaactttggctgatattgatttacaagaagtgcctcgattcaccagtggctttaaagaactagatcgcgtactcggcggcggaattgtgccgggtgcggcgattttgattggtggtaatccgggcgcgggtaaatcgaccttactactgcaaaccatgtgtttactttccggacaaatgccgacgttgtacgtgacgggcgaagaatcgttgcagcaggtcgcgatgcgtgcttcacggcttggtttgccgaaacagcatctaaaaatgctctcagaaaccaatgtggatcggatttgccagattgctgagcaagaaaagccgcgcattatggtcatcgattcgatccaagtgatgcatgtggcggatgtgcaatcgtcgccggggagtgtcgcgcaagtgcgtgaatcggccacggcgcttacgcgttatgccaaacaaaataatgtggcggtatttattgtgggccacgtaaccaaagatggtacgttggcgggacctaaagttcttgaacacatcatcgattgctcgattctgcttgatggtgatacagacagtcgttttcgtacacttcgtagtcataaaaaccgttttggtgcggtcaatgaactcggtgtgtttgcgatgactggacaagggatgcgtgaggtgagtaatccatcggcgattttcctttctcgtggagaagaagccacatctggtagctcagtgatggtggtgtgggaaggaactcgcccactcttagtcgagattcaagctttggtcgattactcacaactcgctaacccaagacgcgttgcggttggcttagaacaaaaccgtctctctttattactggccgtgctgcataaacacggtggtttgcaaatggctgatcaggatgtgtttgtgaacgtagtcggtggtgtgaaagtgacggagaccagtgcagatttagcgctactcatggcgttattgtcgagttttcgtgatcgtccgctgccaaaagatgtcgtggtttttggtgaagtcggattggctggagaaattcgtcccgtaccgagtggtcaagagcgccttaacgaagccttcaaacatggttttaagaaagcgattgtgccgattgccaatatgccgaaaggtggtattgaaggtatgcagatccacggtgtgaaaaagctttctgatgcgatcgcggcttttgatgagctgtaatgggtagttggttttgaacacgaatgacgccaaaaagcgcagcgtaaaaatatcatggttgcgcctcgcgagccgtttgaggatcacctatagtttctcagcgataggcactcgttcatccccttggctacttgaaactgctgccgtgtcggctgcaacgctaagtcgctagggcatattttttttcagcaagcgcatgcaggggtatcagtcttgacagattgtgatatactctgcgcgcactttataccttattaacagagtaagacaatggcagatttatcattatacagaaacattggtatcttcgcgcacgttgacgcgggtaagaccactaccactgagcgtatcctgaagctgactggtaaaatccaccgtctgggcgaagtacatgacggcgcttcaacgatggacttcatggaacaagaagctgagcgtggtatcactatccagtctgctgcgactacctgtttctggaaaggtcaccgttttaacgtaatcgacaccccgggacacgttgacttcaccgttgaagtataccgttctctgaaagttcttgacggtggtatcggtgtattctgtggttctggcggtgttgaacctcagtcagaaactaactggcgttacgcgaacgaatcagaagtatctcgtctgatcttcgttaacaaactagaccgtatgggtgctgacttcttccgcgtagttgagcaagtgaagaaagttcttggcgcaaacccactggttatgactctacctatcggccgcgaagatgaattcgttggtgtggttgatgtactaactcgtcaagcgtacgtatgggatgactcaggtcttccagaaaacttcgaagtgaaagaagttccagcagacatggttgatcaggtagaagaataccgtgaaatgatgatcgaaactgctgttgagcaagatgacgagctgatgatggcttacatggaaggcgaagagccaactgttgagcaaatcaaagcatgtatccgtaaaggtacacgtgatctcgcgttcttcccaactttctgtggttctgcgtttaaaaacaaaggtatgcagctagttctggatgcagttgttgactacctgccttctccaacagaagttgagccacaaccactgactgatccagcaacgggtgagcctactggtgaagtagcaacagtatctgttgatgcaccactaaaagcgctagcgttcaagatcatggatgaccgttttggtgccctgaccttcgttcgtatctactcaggtaagattaagaagggtgataccattcttaacagcgcaacgggtaaaactgagcgtatcggccgtatggttgagatgcacgcaaacgaccgtaacgaagtggaatctgcacaagcaggtgacatcatcgcgatcgttggtatgaagaacgttcaaactggtcacactctatgtgatcctaagcatgaatgtactcttgagccaatgattttcccaacaccagttatctctatcgctgttaagcctaaagataagaacggttctgagaaaatgggtatcgcgattggtaagatggttgcagaagatccatcattccaagttgagactgacgaagattctggcgaaaccatcctgaaaggtatgggtgagctgcacctagacatcaaagtagacatccttaagcgtacttacggcgttgagctggaagtgggtgctcctcaagttgcttaccgtgaaactatcactaaagcagttgaagatagctacacgcataagaaacagtctggtggttcaggtcagttcggtaagatcgactaccgtatccgtccaggagagcaaaactctggcttcaccttcaagtcaaccgttgttggtggtaacgttcctaaggaattctggccagccgttgagaaaggcttcaagtctatgatggataccggtactcttgctggcttccctgtacttgacgttgaagttgaactgttcgacggtggcttccacgcagttgactcatctgcaatcgcatttgaaatcgcagcgaaaggcgcattccgtcagtcaattccaaaagcggctcctcagcttcttgaaccaatcatgaaagtggatgtgttcactcctgaagatcacgtgggtgacgttatcggtgacttgaaccgtcgtcgtggcatgatcaaagaccaagaaatgggtctgacaggcgtacgcgttaaagcagacgtaccactatctgagatgttcggctacatcggttctctacgtacaatgacttctggtcgtggtcagttctctatggagttctctcactacgcaccatgtccaaacaacgtagctgagcaagttattgctgaagttaaagagcgtaacgcgaagaagtaattctttgttttaaagcttaaaaagccccgtaagtaaaagcttacggggcttttgttttcctgcctgtgaggacggctcgacaagcaaggccgtccgcttagcgtgctaagtccttactcttcccaaacgacgagctgacctttaggccagttttggccgacatcgtgatatttcttctctagaacatgacgtttgatcttgagcgttggcgttaagatgccgttatcaatgctccaaggatctttaatcattaacacccctttaatttgttcgtgagattccaattcactattgatgcgtgctatcactttttgggtggtgcgttcataacgcgcacgatcaaagtgagggaaattgtgcggaacggctaacaaaatgggggctgggagaccagagccgatcaagcacatcatctcaactcggctgtattcaaacagctttttctcgataggtacgggggcgacgaacttgcctttagcggttttaaaggtgtcttttttacgaccttgaatggttaaatagccttcactatccaatgacccgatatcgccagtatgtagccaaccgtcatcgttaaagctttcggctgtcgcggtgtcatttttatagtagccagcaaacaagcctttgctgcggactaagatttcttcatcctccgcgattttcagttcaatgcccggtcctgcattacccacagtaccgattttgtcagcacggaatggatagttgagtgtgctgtatgcaaaggactccgtcatgccccacgcttcggtaatgtttagtccgacactgcgataccattcgagtaatgcaggagagactggtgcggagccacaaccgagcacgcgagcttgatctagccctaaaccatcggccaacttacgtttgatgagtgagttgacgaaggggattttgagcagaatattcagctttttctgcggcagtttatcttggatgcgttgttggaacagtgtccataaacgaggtacagaaatgaacagggttggacggtgcattttgacatcttcgataaaggtatcgagagattccggaaatgcggtcagtacgccaccgatgatcgatgaaccaaaaatataaactcgctcagtgatatgagcgagtggcagatatgagaaaagtcgatcgttttcttcgatacctatgtggttgatcagttgttgggcggaccaagtaaatgcgccataagtgagcatggcacctttcggttgtcctgatgtaccagaggtataaacgatggacatcagtttttcatcaaagtgggtggggcgctcttcactgggttgatgctgtttgatcagcgtttgaaactcatattggcatttggctgccgaaggataaggaagcgagatactgataagattaggacgctctgctaacacatgcgcagtggctttattatcatccagcttgccgacgatcaggattttactttcactgtgctcaaggcagtaatcgatagtctcactgcctgcggtcgggaagatcggcacactgatgtaatccccgagcatcatggctaaatcgcaaataaaccattccgcacagttttttgaaattaatgcaactttatcgcccggatcagcccctaaggctcgcaaagcggaaacgaggcgtagagccttatccgcaacttcggcgtaagtaaactcaacaaattggcggttaataatctgttttaggtacacctcattcggacgctctttagcccaacgcagcaacatctcattgggtggtgggagagcacaaggagggtgattgaactgattaggctggatcattctcaaactccgggtaacgttgttattatgttaatttattgtaaaacgtagcatggagagcgtatttcatcgaacctttttgcataagagaagtgtaaaactttacgatttgttgacgagatcaaacaagactctgaatctaatcagtggattacttaccctaagcggttcaattttgtcgatgcacgtgattgggaggatgcgctcagtgggtgattccctggtccttgggatcttgttccgggaaacgggcaacgatctctttaagctcttcttgattctcacgcagggcattcacacaatgacgatctaacttgccatcgctgaccattttttccagttccaatagggcatgaggaatggattgcgcttgtttgtaagggcgatgtgcggtcagggcatcaaagatgttagcgaccgctataatgcgtgctgggataggaatttggtcactgactagaccaaatggatagccgctgccatccaaaaattcatggtgataagccatgatttctcgcaaaacggccaaacaaggatggtgaggtgtacctagctttgcaatcacttcattgagtaaatcaatgccgtattcaatatggttatgaacttgctctttttcatggttggccagtgaagcgcgtttttgcagaagatcggctggcaaggccaatttcccaagatcatggcaagtggcaaactggctgatgttttctatgagctcatcatcgagcgcatactgatctgcgacatcgagtgcgatgatccgcgcgtaacggctgatccgctctttatgttgcttgatgtgaagccagtgttcgggagattgagtttcaatttggtgtacatggtcaaccaattgatggattaaggcgtattcaccacagatagattgttggatgagcgataaataggtttctagccgttcaacgactgacgcagaaaaataatggctcattgaagcgttaaaaaataagaaaccgacgaaggtgtgttgatcaaaaacgggtttcactaacgaagagcaatattgctgttccagcaaccagcggttatgaggtgtatggcttttggcttgattcgcgagatcgtgaataatgcgcagtgctccggactctttgctctgttgtaaagagggtaagttcgcgagtggtaactcataatgcacaaagtcatgactgaccggagagctgtcggcacaggttttaatcgagtctttcttctcatcgtacagagcgaatgaaatcctttggatatcaggcagctctacccgaattttctcgagcatattggttaaataggtatttagcgaccccaccgatgggtaatagcgaaactgaccgactttgggttgcatctgcatatcaccgcccttccttgctagctactcattaagtttagacaaggttttgtggattgccgcattagggcggtgcttttctatgtctgttttactactcgaggtctgttttactactcgatcacatcccgttgctttttagattaagccgctgagcacaccaaataacaaggtgctccccaccatgccaattaaaggaagtcgcaagactttaaacaagaagaagccgactaacagggctgcccaatcgagtggggcatgtactgtgctactccaaacgggttgatataaggcggcgagcagtaaaccgaccacacaggcgtttactccttgcatggctcctgcaactttcgggcgctgagccaatgccgaccagtttttgagtacgccgagtagcaataaaaaaccggggagaaacacggctaaggttgcgattaaagcgccaaccacgggcatctctggtgtcagcacatagccaaggtaagtggctaaggtaaacattgggcccggcaccgcttgtgctgccgcgtagcctgtcagaaattgatcggtcgataggctgtcacctaaggcattttgcagcaagggaagaaccacatgaccgccaccaaacactaagcttcctgcttggaagaaatggccaaacaactcaaccagcggtgagcttgcagccaagagcggcagcccgagtaataaacttgcaaaaagtagcagtgaaagccaagaggggctgaacgtggttgtcgaaaatgactgttgtggtgccaagcgggcttggccaacgaaagcggcgatcagaaggaccgcaaactgagtgatgagaccgggagctaacgtaatcgcaaccgcagtcagaacacataaccctgcagtaaggcgttgctgacaaaaattgcgatacatggttaaacaagcatcggccaccactatgatcgcgagtagcttcaagccatgaatcatttgttcaaacagtggggtatcaaggagatggctgcttagccccgcgagcagcagcatgatgagcacggagggaagggtaaaaccgagaaacgctgcccaagcgccagccagaccaccacgatgataaccaatcgcaaaaccaacttggctagaaccggggccaggaaggaactggctcagtgccacaaattgtgcatattcttgctcgctaacccagcgtaatttctcaacaaaggtgtggcgaaagtaacctatatgtgcggctggcccaccaaaactcacccatccgagagcaaaaaaagttctaaaaatcgttagcataatgatctgaagtcatccgtaatcaatggaaggtcaacatccgtaggagcataggttatggagagtcaaagcgcagaacaactccgaatgtgtaaaaaattacaccattatgatggcaatcgtatgaatcgattcagaaatagaaaaattgggtcaatatcgacctctatttaaattgtggaaacgtttacacaattggtgagtggttcacagaatcggtgtttgaaagtttgttagacttttttgcatctgcagcatgtcatcattcctattcaaagctgcgaatcttattgaatgacttctttactcctcggcttgagggatgtacgccgtagagcaaaggcgttattggcttgttgcttcgcgtattcaagaggatcttatgcgcaacttctccgatattcttcttagccaagattggcaaaacccgcacatcgttaaatggcactgccgtacaccccatgttcctttgcacagttatcgcactgagcaggaggctcgtttggatgttggggggaatcgccaatctctaaatggtcagtggcggtttgctctgtttgagaagccagaagcggttgagcctgcggtgatagacccggatttcgatgatagcgcttgggcgcacattcctgtaccgagtaactggcagatgcaaggctttgataagccgatttacaccaatatccaatatccatttgcggatcggccgccttacgtgccgcaagataatccaaccggctgttatcgccaccgttttacactggaaaaacaagcgctaaccgagtccattcgcattgtatttgatggggtcaattcggcatttcatctgtggtgcaatggtcattgggtcggttattcgcaagatagccgcttgcctgccgagtttgagttaaccccttatctacaagagggtgaaaacctgttggtggccatggtgctgcgctggtctgatggctcttatttggaagaccaagatatgtggtggctgagtggcatctttcgcgatgtgtatctctaccgcaagccgatactcgcgattgaagatttttttatccgcactgaattagatgcgctttatcaacacgctgaattgcgagtagaaacacgcttaagccaagtgactcgccatcatcaagtgcaagtggctttattcgatgcacaaggtgaatgcgtggcgcgttcacaagccttacatacaggccagcgtgtagtggatgaaaaaggagcatggcacgataaaaccgaacacagtttagcgatttgctctccgacactgtggagtgatgaagcgccttatctttaccgctgcgtgatctgtttgcttgatgaagatggcgcgccgattgagtttgaaagtgcagcagtgggttttcgcaaagtagaaatcactcagggactactgaagctcaatggtcagcccttgttgatccgcggggtgaaccgtcatgaacatcatcccgaattggggcatgtgatggatgaagcaagcatgcgccgcgatattgaattgatgaaacagcataatttcaatgcggtgcgtaccgcccattaccccaatcatccgcgttggtacgaactgtgtgatgagtacggtttgtatgtggtggatgaggccaatctcgaaacccacggccaatttccgatgagccgactttccaatgatccacaatgggtgaatgcctatttgcagcgcatgattggcatggtggagcgcgataaaaaccacccttgtgtgatcatttggtcgctcggcaatgaatcggggattggtaccgcggccgctctagaggtgagaggctgaacctctttgcattcagcctgccgagcaccgactcggtgccactttttcaagttgataacggactagccttattttaacttgctatttctagctctaaaacgactgctttatttcatcagggtcgaggtagtggtcgatagatcctttctcctctttcagtcacctcctagctgactcaaatcaatgcgtgtttcataaagaccagtgatggattgatggataagagtggcatctaaaacttcttttgtagacgtatatcgtttacgatcaattgttgtatcaaaatatttaaaagcagcgggagctccaagattcgtcaacgtaaataaatgaataatattttctgcttgttcacgtattggtttgtctctatgtttgttatatgcactaagaactttatctaaattggcatctgctaaaataacacgcttagaaaattcactgatttgctcaataatctcatctaaataatgcttatgctgctccacaaacaattgtttttgttcgttatcttctggactacccttcaacttttcataatgactagctaaatataaaaaattcacatatttgcttggcagagccagctcatttcctttttgtaattctccggcactagccagcatccgtttacgaccgttttctaactcaaaaagactatatttaggtagtttaatgattaagtcttttttaacttccttatatcctttagcttctaaaaagtcaatcggatttttttcaaaggaacttctttccataattgtgatccctagtaactctttaacggattttaacttcttcgatttccctttttccaccttagcaaccactaggactgaataagctaccgttggactatcaaaaccaccatatttttttggatcccagtcttttttacgagcaataagcttgtccgaatttctttttggtaaaattgactccttggagaatccgcctgtctgtacttctgttttcttgacaatattgacttggggcatggacaatactttgcgcactgtggcaaaatctcgccctttatcccagacaatttctccagtttccccattagtttcgattagagggcgtttgcgaatctctccatttgcaagtgtaatttctgttttgaagaagttcatgatattagagtaaaagaaatattttgcggttgctttgcctatttcttgctcagacttagcaatcattttacgaacatcataaactttataatcaccatagacaaactccgattcaagttttggatatttcttaatcaaagcagttccaacgacggcatttagatacgcatcatgggcatgatggtaattgttaatctcacgtactttatagaattggaaatcttttcggaagtcagaaactaatttagattttaaggtaatcactttaacctctcgaataagtttatcattttcatcgtatttagtattcatgcgactatccaaaatttgtgccacatgcttagtgatttggcgagtttcaaccaattggcgtttgataaaaccagctttatcaagttcactcaaacctccacgttcagctttcgttaaattatcaaacttacgttgagtgattaacttggcgtttagaagttgtctccaatagtttttcatctttttgactacttcttcacttggaacgttatccgatttaccacgatttttatcagaacgcgttaagaccttattgtctattgaatcgtctttaaggaaactttgtggaacaatgtgatcgacatcataatcacttaaacgattaatatctaattcttggtccacatacatgtctcttccattttggagataatagagatagagcttttcattttgcaattgagtattttcaacaggatgctctttaagaatctgacttcctaattctttgataccttcttcgattcgtttcatacgctctcgcgaatttttctggcccttttgagttgtctgattttcacgtgccatttcaataacgatattttctggcttatgccgccccattactttgaccaattcatcaacaacttttacagtctgtaaaataccttttttaatagcagggctaccagctaaatttgcaatatgttcatgtaaactatcgccttgtccagacacttgtgctttttgaatgtcttctttaaatgtcaaactatcatcatggatcagctgcataaaattgcgattggcaaaaccatctgatttcaaaaaatctaatattgttttgccagattgcttatccctaataccattaatcaattttcgagacaaacgtccccaaccagtataacggcgacgtttaagctgtttcatcaccttatcatcaaagaggtgagcatatgttttaagtctttcctcaatcatctccctatcttcaaataaggtcaatgttaaaacaatatcctctaagatatcttcattttcttcattatccaaaaaatctttatctttaataatttttagcaaatcatggtaggtacctaatgaagcattaaatctatcttcaactcctgaaatttcaacactatcaaaacattctatttttttgaaataatcttcttttaattgcttaacggttacttttcgatttgttttgaagagtaaatcaacaatggctttcttctgttcacctgaaagaaatgctggttttcgcattccttcagtaacatatttgacctttgtcaattcgttataaaccgtaaaatactcataaagcaaactatgttttggtagtactttttcatttggaagatttttatcaaagtttgtcatgcgttcaataaatgattgagctgaagcacctttatcgacaacttcttcaaaattccatggggtaattgtttcttcagacttccgagtcatccatgcaaaacgactattgccacgcgccaatggaccaacataataaggaattcgaaaagtcaagattttttcaatcttctcacgattgtcttttaaaaatggataaaagtcttcttgtcttctcaaaatagcatgcagctcacccaagtgaatttgatggggaatagagccgttgtcaaaggtccgttgcttgcgcagcaaatcttcacgatttagtttcaccaataattcctcagtaccatccattttttctaaaattggtttgataaatttataaaattcttcttggctagctcccccatcaatataacctgcatatccgttttttgattgatcaaaaaagatttctttatacttttctggaagttgttgtcgaactaaagcttttaaaagagtcaagtcttgatgatgttcatcgtagcgtttaatcattgaagctgataggggagccttagttatttcagtatttactcttaggatatctgaaagtaaaatagcatctgataaattcttagctgccaaaaacaaatcagcatattgatctccaatttgcgccaataaattatctaaatcatcatcgtaagtatcttttgaaagctgtaatttagcatcttctgccaaatcaaaatttgatttaaaattaggggtcaaacccaatgacaaagcaatgagattcccaaataagccatttttcttctcaccggggagctgagcaatgagattttctaatcgtcttgatttactcaatcgtgcagaaagaatcgctttagcatctactccacttgcgttaatagggttttcttcaaataattgattgtaggtttgtaccaactggataaatagtttgtccacatcactattatcaggatttaaatctccctcaatcaaaaaatgaccacgaaacttaatcatatgcgctaaggccaaatagattaagcgcaaatccgctttatcagtagaatctaccaatttttttcgcagatgatagatagttggatatttctcatgataagcaacttcatctactatatttccaaaaataggatgacgttcatgcttcttgtcttcttccaccaaaaaagactcttcaagtcgatgaaagaaactatcatctactttcgccatctcatttgaaaaaatctcctgtagataacaaatacgattcttccgacgtgtataccttctacgagctgtccgtttgagacgagtcgcttccgctgtctctccactgtcaaataaaagagcccctataagattttttttgatactgtggcggtctgtatttcccagaaccttgaactttttagacggaaccttatattcatcagtgatcaccgcccatccgacgctatttgtgccgatatctaagcctattgagtatttcttatccatttttgcctcctcctctagtaaaagttaaacaaaattatttgtagagggaaaccgttgtggtctccctgaatatatcatacgagccttatgcatgcccgtaaagttatccagcaaccactcatagacctagggcagcagatagggacgacgtggtgttagctgtgctctagaagctagcagagtttgtagaaacgcaaaaaggccatccgtcaggatggccttctgcttaatttgatgcctggcagtttatggcgggcgtcctgcccgccaccctccgggccgttgcttcctgcaccttaattaagatctggtaccaatcatcacgccatgtatcagtggacgaaacagcgcgacccatcgcgtcctgtgcaatacgaagggggcggcgctaatacggcggcgaccgatattgtttgcccgatgtatgcgcgggtcgatcagcatcagccacatcctgcggttccaaaatatgcgctgaaaaattggatcagtttgccgcaggaaaaccgccccctcatcttgtgtgaatatgctcatgcgatgggcaacagcttgggcgcgttttataaatactggcaggcgtttcgtgagtttcctcgtctgcaaggtggctttatttgggattgggtcgatcagggcatttccaaatgggatagcgaggggcgccactattggggctatggcggtgattttggcgatacgattaacgatcgccaattctgcataaacggtttgctgttcccagatcgcacgccgcatccggcattacatgaagtcaaaaaagtccagcagccgtaccagttttcgttgagctatcccaagctcaccattcacaatgagcgcttgtttgcagcgctgccgctggagctggtagttagtgtgctatgcgatgggcaagagattaagcaagaacgtctgccgcttgatattgcgccgcgcggcacaatcacgctggatttagcgtcgctgccaatgttgccagagcatgaataccacctcaatgcagtcttattgtgtcgtgaggatcagccatggtctaacgcggggcactgcatcgctagtgagcagtggtgtttgcagccacgaagaagcatgttacctaaaatcacacacgctccgctgcctcaatggcagcaagatggagataaggtgcgcatcgaggcggccaatcagcaatggcagtttaaccgccaaactgggctattggagcagtggtggcaaaatggtcagcccgtattgagtgaaccgctgcgcgataacttttaccgcgcggtgctggataacgatattggtactagcgaagcgcagcatcttgacccgaacagctggatcgcacgttggcatgcggcgggcttagataagctgcgtgtggaatgtgacgatcttcgcgtcaccaccttgaacgagagtgtcgaagtggtgatcgatgtcgcccattaccatcagcaagcgttagcgcttcgtacccgttggcgttaccaaatcttcggtgatgcgcgggtagaactgaatgttgaggtgatgctgtgttctgatttaccgccgctgccaagagtggggttaacgctcgcattaccagtggcagaaaacccagtgtcttggtttggtcgcgggccgcatgagaattatccggatcgtttgcaatcggcgcatgtggggcgatacaccgccacggtggatgagctgcatacaccgtacattttcccgagcgaaaatggtttgcgttgtgatactcgccagctacaagtgggcgctttggtggtggaagggcattttcacttctcgctcagtcgctactcacaaacgatgttggataaagccaaacacagcaacgagttggtggcgggcgataagtggtatctcaatctggatgcgcagcatatgggcgtgggcggcgatgattcgtggagccaaagtgtgcaccctgaatttttgctcactcagccgcactatcagtatcagctcaccttacgtgtgaaagcgtcatccccacaataagccagagagccttaaggctctcttttttgtgccacgctgtcgcggcgaacgatggtgggcgaaaagatcatcggatcattttcacgcggtgcatcggttgccaaagcaagagccaactgagtggctttttctgccatcagttggattgggtaacgcacggtcgtcaggcgtgggcgtaagtagcgcgaaatcagggcatcgtcaaaaccaatcactgagacatgttcaggaaccgaatgcccattttcctcaagtaccaacagggctccagcggccatattgtcgttgtaagcgaccactgcggtaaaaggcagtgatttcaccagtaggttagtcatcgcctgttcgccgccttcactgtctgggctggctttttcaatatagctgctgcttagggtgatgccatgttcgttcaaggcttgttgatagcccgcaatacgctgatcggcatcctcaatttgatgagaggagctgatgcaagcaatgtttctatgtccttgacggatgagaaaatcggttgctaaataagcacctttctggttgtcgagtgaaatacagcgatcggcgagctgaggaatatggcgattgatcaacaccagcgtttttacctcgttggcgtactcaatcagctcttcattgggaagcgctttggagtggatgaccagtgcatcacagcggctgttgatgagcagttccagcgcgcggcgctcttcttccgctcggtggtagccgttgccgatcagcaaatgttttccttcgcggtgggcgacagtgtcgacggctttgactaaagttccaaagaagggatcagaaacatcgctgaccaagacccctatggtattggtgctttgattgactaaagcgcgagccgcggcgttcggacgatagccgagtttgtgcatcgcactggtcaccgtatcaatcgaggcttggctggctttcggggatttgttgatgacgcgtgaaaccgttgccacagatacaccggcttcacgtgctacgtcttttatggttgccataagattccttctctatcacaggcgcaatagtagcgctccctgtgaaaacagcgcaattgtaactgagtacataagagtgaattgtgagccatgacgcttgttcaacagggattggcgtaaagtgtaaacgtttttaatgattaagaaggataagagttatggactcggcgtttttgacggtagggtacgatgattttgcgcggctggatttacgtattggcaccattgttgaggcaaagcttcatcctcgttcgacccgcaactatattgtgcagattgcgttgggagagcagatgttgcaagccgtcaccgcgttagcaccttattactcggcagaacaattactcaatcaacaagtggtggtgctgtgcaatctcaaaccgagcttggtagctggtgtagaatcccactgcatgctgctgtgcgcggaaacgcaagatggagaagagagtgtattgctcaccccacaacggattatcgccaatggggtgagaatcgtttagcgtactgcggcaatcagttgatcaatcaagccatgctgctccggttttacccccgccaagttgccgtatttgggggcgtggcggtcattgtctaacggatgttgccagcccaaggtttgctcgacaaattgccgtgcaaacgcttcggaaaactcaaggcagccactgagtacggtatcgacataggtttgcacgatcgggctttgtgaacagggcggttgatgctgctcggtgacgtaaatccaaatcggtttttctggatcaaaatgctcttgtgtgtgaatacgatccgcggttaaagcgatgcgctgataaccacgctcacggcgatcaaattccgctaacgcaacctcatcaatttccaacagcacgccattaatttgcccgtcgccttgatgaaccactaagggtgaaagaatgtaactgtcatcgattttgccaaaatagcgcaccaatccggttgcgctggcgggaatggctcgtccagtctggccggttaaacggcgtgaggcagaattaatcaggcttccatagccaaagatgtacatgatgagttcctgtaacgatttacgattgattatcaaaaaagcgcagacggcgcaaaatccaaaactctaagccgaaaattagcccaagtcctgcacaaaacagcccaaaggcgatgggcgattcagtccccggaatgccgccaacgttcacgcctaacaaacccgttaagaaactggtcggcaggaaaattgccgcgatcacggaaaacaaatacgtgttctggttcatcttctctgcatggtactggcgcagttcacctttgatgatttccagctcactcaagaagaagtccaaggtttcgttaatccgcgttaccgtgttgacgctgtggcgcaaacgtaaatgttggctctgcgccagggcgacttccgaattgagataatcatccaaagcgtattgctgcggcttaatgaaacgcttcaatttgagcagtgatttatgggtttgcatcagctcattactgagttcgagttcttcatcaaactgggtgatgcgttcctcaatctggtcgagatagaggtcgatgtttttattcagttcatcgactacacgcacaatcagttctgccaaattggatgggccttggccggcttcaagcgctgtacgcacggtactgatcgctttcgaaggtgttttacgagtcgagatcaacgcgccgtgataatagagaatacgcacactgagcatatccgcaggatccgcgttatcgttaagattcaccccacgcaagatcagcagaaagttctgttcatcatactgctcaaacagggggcgagtatcttcggccaacaaactgtcgataaccgaagagggaacattttggtcgagtaaccactcgcgcagccctttagcatcgcgttggcagtgataccaatcaccggcttgtagtgtttgcaattgagcaggatgtcgctttggcgcggaatcgccaaaacgccagtgatcgatgagaaactccatggtgatccttgtttcaaaaccttgatggcaagaaagtaacaatggagcgataaagagtcaaagcccagaatatttctgggctttgattagagaaggatattcccttcctacttgaagttgcagcggtgttggctacgttcgttcaccccaatcacatagtctatctatgctcatggggactcactcacttgccgcctacctgcaactccaagttgtttgggaataaacggtttaaaaaccacgcatttgaatgcggcgtaagaactcggtcatgatgcgatcgtagagcagatcgcccaagaaggcgtcttccacatggtgatcgatacttgggttatcattcacttcaattacgtaaacttgaccatcaatctctttaagatccacaccgtagagtccgccaccaatcaggtttgcggctttgaccgccacatcgaccacatgcttcggtacttgtttgagatcgagcgtttcaaagccacctgcggtcacgcggccgctgttatggtgttggtaaatctgccagtggccacggctcatcatgtacttacaagcaaaaatcgcttgacggttcatcaccccgatacgccagtcaaagtcggtcggcataaaggcttgcgccaaaatcagcgcgcttttctcaaacagggtaccggcttctttctccagctcttgctcattgcgcactttcaccacaccgcgagaaaaggcaccatcaggaattttcagcaccatagggaaatccaactgctccatcagcccggttttccactctgggtcaaaactgcggatgatcacgctcttcggtgcgggtaccttgttggtttccaacagctcagtcaaaaataccttgttggtgcatttcatgatcgattcagagtcatccatcaccactaagcccatcttctcagcggttttcgcgaagcgataggtgtagttactgatgttggtggtggcgcgaataaacagaccatcaaattcccccaaacgcgacaaatcatccggtgaaatggtttccaagttcatacccaaacggttggcggcgcgatggaaacgtttgagcgcagaagcatcagacggtggcattttttcatctgggtcgaccagcattgcgatgtcgtagcggtacttcttctcttgctttggacgacgccacactttggtagagaacatttctagagactcaatgaagaaatcctgctcggggtcttctaagtcttgaaacgggaagggagtgattttgatgatctgccattgcccttggtatttgtgcatttccagttcaatcacgggcaccatgaactgctcaaacaggcggcgcgccagtttttctaagcctttttgtggagtgcggccaaagtaaattttggtgttgatgacgtcagtgccactgttcagtttgtgcatcttgatcaggccggaagagaggaaaaacggctgattgatgtcattaatcgccatcacgcgcgggatcacgcggtggccacgggcttcggccatcaaggaaacatagtaaccgctactcatgtagccgtaatcgcgacacaggttgactacctgtacactgcggtgattgaatttccagtcagtatcgagatattgatcgacactaacaacttgttctgaagggaaatattgttgccagtcactgacctgatcggtcacgattaaaaggttagccatcggtatattcttcctattgtcataggtttatgcccttcctacttgtcatggcagcggtgttggctaggttcattcaccccaaacatagagtgaactatgctcatggggatgaattcacttgctgcctacctgcaactccaagtcgtttggggctattatgtgagtcgcaatctcgtcaatccactcattatttaaggacgttgaatggacattcgtcgtgccaatagcgctgatctcaatgcgctcaatgcgttagaacaacagctttttgacggggatagaatctctcctcgccaaatgaagcgttttttacattccgaccatgcggcgttattcgtggcagatgccggcgaccagctggcgggatatgcattgcttctatttcatcaaggtacacagctatcaagattgtattcgattgccgtaaaacctgaattcagagggcagagaattgctcagagtttagtcgagcaatgcgagcgtgctgctcttgatcaaggctcaactacattacggctggaagtgcgtgaagacaataccgccgccctaaaattatatgaaaagatgggctataaaaccttgaagttgctcatccattactatgacgatttgtgcgatgggcgcagaatgcagaaaaggttaacgcctcaagagtccaaagtcttgctaccgatgcctttgtatgtacaaaccacgccgtttacgtgtggcgcagcctgcctgttaatgagttttgcctgcttggataaaacttttgagccgagtcgcacgcaagagatgcaactgtggcgtgaagccaccacgatttttatggcggctgggcatggtggctgcagtggccaaggtttggcgctggccgccgcaagacgtggctatcatgttgagctatggaaccaatctcgatcaacgccttttattgatagcgtacgtgaccccaacaaaaagcagatcattgagttagtgcaccaagatttttgccagcaacttgctgagcaagatgtgagtatgattgatgcgccaccatcgcaagcccagctcgaagagtgggtacggaaaggtgcctgtgtgctgctgctcattagcacgtaccgttttgatggcaagaaagagccgcactggattgtgctcagtggtttgagtgataagttcttctttttccacgatccgcatgcagaatcggaagagcatgtgagcggttcgggttatattccggtgggcaaagcggcactgtcgcaaatcatcggctttggtaagcaaaagcagatcgcttgtgtggtgatcacacctcgcctatagagtttgagtgaaacacacatcaaaaagtcataatgactcgattttttggtgtcattatgacttttcctttttctagtctattgattttaaatatgaattatcttggcttggtttgtgctcatcactggttcggtctgtgatgaagtcggcgaaggagccaaagtgatcaacattatcgataaacgtgtcgaagagcgtattcctgctgtgctgcggttggggtttcgtcctttctttttgcttggcagtatttatgccgtgattgccatcctcgcgtgggtttggatgtttcaagctgggcaaccgcaactattgcaagtccccgcgctatggtggcatgtgcatgagatgttgtttggttttgcaatggcgattgtggccggatttctgcttacggcggtgcaaaactggacgggtattactggcacgaaaagtcaccgtttagctggtattgtggctttgtggctaatggtgcggattctgttttggttgcccgtgccgctgtggttaacgtcgagtattgaagctctatttcttctggcggtggcctatgaagtggggttacgggtggtaaaagccaaaggttggcgcaacctattttttatccctctgtttctgttggcgattgccgctaactttgccagctacgccaccattaaaggcatgccgccattcccgagcagtgcggtgtggcaagccatgctgtggtggtttatgttgctgctttcagtgatgggcgggcgagtgattccgtttttcaccgcaagacgtttccagtttacaaaagcggagccgattttggctttggatgtgatcgctaacggtagcttactggcgctgtttgtacttagtttcttcccattgaccatggcacaactcggccagcctttgatgctggtagctggcgtcgcgcaattgatccgctttttacgttggcagccttggcgtactttcagtgagcctttggtgtggtcactgcatgctgcctatctgtgtatcccgctgagtttgctgctgcgtgggggagtgagtaacgcttggctgaaccacaacttactgcatttatttgcgataggtgcgctctcaggcctagttttaagcatgattgcgcgtgtcactatggggcatacgggacgagcgatttatcaaggccctaacatgcaatgggcatttatcgctttgttgcttgccgctgtcgtgcgtggtgtcggtgtgggtttgctaccgcagcagctgctgatttgggtgaacctgagcgccgcgctgtgggttattgcgtttgctctgtttgtgctgcgctttggcgcaatgttgctgaaaccaagagtggatggtcatcccggttaagcgtattgaaatgcaagatttgagataaaaaaatggcttggaaatccaagccatttttcttgcatcacgaacgtatcaagatcagttgttcttgtgcagttcgctgttgagttccacggccgatttgttggccagacactcaatttgtccagtcagtgagttacgacggaacagcagatccgaaacgccagccagatcgcgtgctttaacgatatcgacttggttgccatctttatccagcgtgcgcactttggtgccagccgtcacgtacaagcctgactccacagtacagcgatcgccaagtgggaagcccaagccggcgtttgcaccaagcagagagttttcaccaatcgataccaccactttgccgccacccgagagcgtacccatgatggatgcgccgccgccgatgtctgagccattgcccaccacaacacccgcagagatacggccttcaaccatgctcacgccagtggtacccgcgttgaagttgatgaagccttcatgcatgactgtggtgccttcacccacatgtgcgccaagacgtacgcgagaagtgtccgcgatacgaatacctgcagggaccacgtaatcgaccattttcgggaatttgtcgacgcaatcgactgtcagcactcggccagccagacgcgcttcgatttggcgctctgccagttctggaagatcaatggggccttcattggtccatgcgatgttgtgcagcagaccgaaaatcccatccagtaccgtaccgtgtggtttaaccagacggtgagaaatcagttgtagcttgaggtaaccttctgccacgctttgaggtttgtcatcacttgctagaataaccaacacgagaggctgtttggcattggcagctttatcagcaaatgctgcgcttgcggcttgttgatgagcggcgaaaactgcggctaattgcgcgctttgtgccgctgtaatgtctagcgcttgattgccttcttggtaacctgcgatcggtgccaatgctgcaaccaaagcgtcgctaggagccagaatgggggttgggaagaaggcttcaataatttttccatcacggtttttggtcgcggttgctagacctaaagcaaagtacgccatgtgtattctccatcatcaaatgtgggttgagctgtttgcccgcttgtcatacatggacaaagcaaaggcattgagttgagcatccacagctcaaccgataggtggttcatcataaagagtggatgagcaggataaaagaccgcagaggcaatacgtctgtagaagaatgcattttgtctttttaaagtgatccccgtcctacttgaagttgtagcggtgttggctacgttcgttcaccccaatcacatagtttatctatgctcatggggatgaactctcttgccgcctacctgcaactccaagtagtttgggtataaaaagaatcccgttcatttttcgcagtgcttcgtctgtgagccaacctcagcaaataaaaaaccgctgggttgagcagcggttttcttgattaggcagcgtcgtcgacagactcatcgtcatcactgtctgcaaccgctttcggcttcttgcccgttgctggagcaggtttacgcttggctcccagtgcgcacagtacgtcttctttgttttgagccaagaacatcgccagctcttcttgcttggcttcatcttcgatcagagcacttttacccagcagttcgaacaactcgtctgccatatccagcattttgtcataagcgtcagcttcggctttcgaggtaaaagtcattttctcttctccgttgcgctccaccacgtacttcacgataacagccatggttaatcctctagtttgtcgctaaaaataactggctgtttatacagttttcattcactaaagtccagttgcgaccaccaaaatgcgcgctgagtcatatcccttgattcactgattaatcgagttgcagtagggcgctttggctcgcccattggggacaaaattcaatgaactgccgtagcagtgggttttggtatttctctttatgaaccaacatccagaagcgacgtttcatatcgagaggaatattgagaatcaccacacgcccatcttgttgaggcgttttcgcggctaatcgagacaagcagcctagccctaagccggaagagacactattgatcagcgcttcggtggtattgagctcaaaggcttcaatccagtgctcgatgcgtggcgcaatcacacgtaagaaaaactcgcgtgagccagaacctgcttcacgcagcacccaatcactgtgttcaaaatcgctcatgactaagcgctcttgctgcgcgagaggatgatctggcgcacagatgatacacatttcatcttggctaaactgagtagagatgagctcgggatgcagcgttttgccttcaatcaaaccgatatcgagctcgtaatcgaccagcttttggcacacttgcgctgagttggaaataaacaggctttgtgacggatgcggatgcaactgacgaaaggcgctaatcaaataaggtgcaacttgattacctatggtatcacttgaaccgatgcgcagtttgccagtgagcacctgctgctctgcaaacaaacggtcgatatctttggcgcgctgcagcagttcatcggccattggcagcagtttttgcccttcttggttaagcaccaagcggttgttgacgcgatcaaacagtgcatggccaagctgtttttccagctctgacagcgcgacactgaccgcggctttggataggcacagcacttctgcggcgacagtcaaacttttatgttgagtgatggtggtgaaaacccgcaattgtttgagcgaaatatggctagccatggcgaccgtttagttttattgaacatgtgttagaaataattagatagttgaaaacaaagtgcaagcgtaagatgcgtttattaaccgataaccatcaatagagagacagtatgattcgagcagcaaaagcgaaagtgatgggagcgccgaccccaatggccggcctcgcgctagggattgcgagcttgggatggagttgggaaaacatgattgcggcacacggtgtcgcgcagtgggtgggtgcagcaatcgccagtgtgctattgattgtgctggcctttaaatttttatggcacggtcacttgttacgccaagatttggcgcatccggtagtgggcagtgtggtgccaacctttgccatggcaaccatggtggtatcggcgtcattggggcatttttaccctgtggctggcgatgccttgtggctgtttgccgtgggtttacacattctgtttttggtgagttttttgtatcaccgcgcccaagcgtttgagctgcaccacatggtgccaagctggtttgtgccacctgtcggcattatcgtcgctgacgtttctttctcgggccatcctgcgttagcgccaattgcctacgcgtgtttagtgtttggcatgctggcttacgccgtgatgctgcctatgatgatctatcgttttatttttacacatgaaattccagatgcggcgaagccaacattggcgatcatggccgcgccagccagcctctctctggcggggtatttgaccgtagtgtccgagccttcacctgtgattgtggcgctgctgtttgggattgcggtgctgatgaccgccatcatctacttggcgttcacgcgcttactgcgtctgccctttagtccgggctacgcggcattcaccttcccgatggtgattggtgcgaccgcactgtttaaaatggcgcactggatggaaaatatcggcgtggcagagcattacgtagcacaagtgcattggttagcgagccttgagctgatcgtagccacggtggtggtgagctatgttgcgattcgctatctggccttttatcaaccacataaagtgttagtgggttctcgttaaccatccccttcctacttgaagttgcagcggtgttggctacgttcgttcaccccaatcacatagtttgtctatgctcatggggactcactcacttgccgcctacctgcaactcctagttgtttgggtatatcaagttgtttggggatatattgagatcctagcccacgcttttttatccttcccgacatgcacttatgctactctcagctcatgatgagtcgagcagcatgagtgcattgtgtttacggtctaccactccaaccaagttgaaacgctgaagatcctgttggtgcatttaatcaaaaatgaaccgttggacgatccctttattcctgagagcattttggtgcaaagccccggcatgtcgcagtggctgaaaatggcgctggccagtgaattaggggttgccgcgaatcttgagtttcctctaccggcaacctttatctggcagatgtttactcaagtgttgcccgatgtgccgcagcgcagcgccttcaataaagaagccatgagttggcgtttgatggagctactgcctaagctgcttgaccgcaccgaattccaaccgctgcaacgctatttacaagacgatgaagatgattctaagcgcttccaattagcggaaaaaattgccgatatttttgatggttacttggtgtatcgccccgattggattttaagttgggaagcaggggaagacgtggtggaaatcgctgaccaacacccgtggcagccgattttgtggcgtgaactctacgcttacacgcataagcaagggcactcgatttatcaccgtgccaacctctatcagcgttttattgagcagttggcgagtggcgactttgatcgcagcacatggcctaagcgcttgttcatcttcggtatttctgcgctgccgccccgttatattgatgcgctgcgtgcgatgggggagcatatcgatgtgcacctgatgctgaccaacccttgtcagcactattggggcgacatccgtgaccgtaaatatctggcgcgagtggcagcgcaaaaacgcaaaatcctgcaaattaatggtgagcaagtcaccatcggcagtgaagtctcgccgctcaaaggcgatgtggaaaactatctgcaagagtcgatgcacctgagtcacgcggtgggcaatagcttactggcttcgatgggcaaaatggggcgcgataatctctatcttcttgcacaaaacgatcagtctgaattagagctgtttattgagattcaacgcgactcgctgctgcatcacatccaagcagatattttgcatctgcaagagcatcaagacgatgccaagtttgccagcagcggtcataaacccagcattgccgcgcaggatgattccctgcagattgccctatgtcacagcccaattcgtgaagtagaagtgctgcacgaccgactgctggccgagtttgagcgtgaccctagcctaaaaccgcgcgatgtaattgtgatggtgccagacattaacgcctacgcgccttacattcaggcggtgtttggcaatgcgcccggcgagcgttttattccgttttcaatttccgatcgcagcgccgatcaagaaagcccgattttaaccgccttcttgcaactgctcgcgctgccgcaatcacgctgtctggcttctgaactgcttgagctacttgaaaccccggcgattatggcgcgttttgcgattgacgaagaagagtttgccactgccaaacgttgggtcgaagaagcgggcattcgttgggggctgaatagtgacactggcgcagagtttgaattgcccgccagtgaacaaaatacgtggcagtttggcattgaacgtatgttactgggttacgccatgccggctgaagcggggttgtatgaacttggcggccagtggcttgccccctataaccaagtgcaaggcatgagcgccgagttggcgggtaagctagcacactttgtgcaaacgctcagcgagctgcgtagccaactggcgcaaactcaaagcatggagcagtggcgttattggctcaacgagctgctagagcgctgttttagtgtcgatctgcaaggtgagctggcgctgaaaaccatccgcgatagtttggtgaacctaaaacagcagttggccgacgcgggctaccaacaagcggtttcaccggccatcattcgccaagtgctgaccaataaactctccggcacgcggattagccaacgctttttagcgggacaagtgaacttctgtaccctgatgccgatgcgttcgatcccgtttcgccgagtttgcctgcttggcatgaatgatggtgtttatccacccaatgaaatggtggaagggtttgacctgcgcaatgtgcagcgccgagtcggcgaccgttcacggcgtgaagagtcgcgctacctgttcctcgaagccttgttgtcagccaaagagcagctgtatatcagctatgtcggccgctcgattcaagataacagcgaacgcgtgccttcagtgctggtcagtgagcttttggaatattgcgagcagaactactgcttggctggcgatgaaaatctagaaagtgatgactccggacgtcgcttggttgagcacttaaccacccagtatcctatggtgccgttcagcccgcaggcgtttatcgctggcagttttgcccgtgaatggctacctgccgcgcgccgccaagggcagagtagcgccgattttctcacgccactcagtgattatctgctcgaagtgagttggccgatggagctggatctggtcgagctgcaacgtttttggcgtctgccggtggagtatttcttcaaacgccgcttgaaagtgagctttgagccgccgctggccgtgctggaagacgatgagccgtttgctttggatggattgagcgcgtatcagctgcgtgatgagttggtggaaaatctgctcgcttgccgtgatggcgcagagcgcgaccaagtggtggcgcagtttgctaagcagcaacgagcgcaaggcaagttgcctgtggcagcgtttggcgatcttgaattggcgcaaagtgcgcagcaagctttggcgctggcggaaaaaattggctttttgtgtcaccaaccactggaagatgaagagattgatctacgcttacagccctttgacgatggccgagaagtcttactacgtggttggctcgtgaagcgttatcaatctggcttggtgcgcgcacgcagtggcgcgattcgctcggaagatttattagccgcatggattgatcatctctgcttggcggcgagcggcaaagccgtcacgacccatttgattggttatgagcgcaaagaaggagtgcagcaccaaatgctgccgccacttaatgacgcgcagcaagccaagacgctactgagtgaactggtggcgctgttttgccaaggcatgaaccagcctttggcttatttcccgaaaacggcgttggcttgcgttgaggccggattttcccgtggcaaatggcaggaagatgaagagaagtcctacaagaaaatggcggacaccttcaacgatagcttttacatcaagggtgaaggcggtaatcgctacatcgcgcgtatttggccgcagtggagtgatgaactggcaaaaacgctgcgccaattggccatcaaagtgctgcaaacaccgcgtttacaagtgcaagatgccgaacaggtttaatcatgaatgacgtgggaagtgggtggccgccagaaaatcattattggtgtagggcgttcgctgtacggccacaggtcagagggacctaaattcttgtgtaaccaatgaatttgttaacgtgcgcgcagtgtaaagcgccgccttggcttgtgccgtgaagtggatcccataagcccatactcaatcacggtttttagtttaatgcagagaaatattcgttttaggtcacatctctgtcatcggtagatagaaggattaaggctgatgagtgccgattcaaataagctcgctgttacgctcgatacgttgcgctttcccttgcatggagcgcggctgattgaagcctcggcaggcaccggaaaaacctataccatcgcagggctgtatctgcgtctggtgcttggacatggctgcgcggaaactcgccacgcgcatccactgagtgttgatcaaattctggtggtgacttttaccgaagcggccaccgcagagctgcgtgaccgtattcgtcgccgcttgcacgatgcgcgcctcgcctttgctcgcggcgcgagtgacgatccactgcttcgctccctgctggctgaatttaccgatcacaacttagccgtctctttgttgctgagtgccgagcgacagatggatgaagcggccattttcaccatccacggtttttgccaacgcatgctgacgcaaaatgcgtttgaatcgggcagtcgctttgaaaatgaattcgtcaccgatgaaagtcgtctcaaagcgcaagtggtggccgattattggcgcagacagttctaccccttgcccatttccctcgcgagcgaagtgcgccgcttatggccggcgccctctgcgctgttggctgagattgccggttatctttccgggccgccagtcaaactgactacgcctttaatggaaggggatttggctgcgctgcaacaagcgcagatagcgcgcatttgcgagattaagcagcactggttagtggagcgagaggagattgagcccgccgtaactggctctgacctgcacaaaaatagccaaaatgcgctgctgcgccgtttgccgattctggatgcttgggcgcaaagtgaaacgcacgatctgcacgtgccgtcagagcttgaagagttcacccaaagcggattgcttgccaaatcaaagaaaggcaatccgccacaattagcgctgtttgaacgaatagaagcatttcttgctgagcctgtttcactcaaaacaccacttttggtgcatgcgattcatcactgtcgtcactggttggcgaaagccaaatctacccatcactggctctcgtttgatgacttgctgactcaactcagcgctgcgctcgataatgatgagcaagggctattgggtgagcggatccgcacgctgtatccggtggcgatgatcgacgaattccaagataccgacccactgcagtacagcattttcagtcggctgtatctggactatccgcagtgtggcttgctaatgatcggcgacccgaaacaggcgatttacgctttccgtggcgccgatattttcacttacatcaaagcgcgcaatcaggtgaacgctcactacaccttaggcacgaactggcgatccagcgcagcgatggtggcggccgtgaaccaagtgttcagctctgcgactcatccgtttatttacagtgatgacattccctttcagcccgtggcggcaagccctggtgctgataaacgccattggtcactggaggggcaagtacaaccagctttgacctattggtggccggaagatctcgataaaccacaaagcaaaaccgattattacgcgcaaatggccgaggcgtgtgcggcgcaaattcagcacattttgactgcttcggcctctggcgcggcaacgtttcatcgcggcgaggcgattgaagcgggcgatctggcggtgctggtgcgcaccggtaatgaagcacgcatggtgcgcgatgcgctcagtcagcaaggtatcgccagtgtgtatctttccaaccgtgacagcgtgtttgccagcgatgtggcgcaagatattgaacgcttgctgctcgcggtatggcagccggaagatgaacgtttgttacgcgcggccgttgcttcgaatctgtttgcgttaaccgccagcgagctggatgcgctgaataacgatgaaaacgaatgggaacagttgattgcggagtttcgccaatatcgccgtttgtggagtgagcgcggcgtattgccgatgctgcgtgcggtattaactcagcgccacattgccgaacgttggctggcggaaagtgaaggtgagcgctggctcaccgactatctgcacatcagcgaactcttgcagcaagcgacgcgtgagatcgatagcgatcagggcttactgcgttttctgactcaggcgatggcggatgctgcgcaaggattggggggcagtgatgagcagatccagcgcctcgaatctgagcggcgcttggtgcagattgttaccatccacaaatcaaaagggcttgagtacccgctggtgtttttgccgtttgtgatgagctatcgcgagagcagtgaaggcaaatattacgatgctgaatcggccaccacttgggtcgatttaaccggcaatgaagaggcgttagctaaagccgatcaagaacgtttggcagaagatttacgcttgctgtatgtggcgctcactcgcgcagtgtatggctgttttattgggattgcgccgctgcgcaacggcaattcgagccaagagccgacctcggcgcatcgtagtgcgatggggtttctgctgcaagatggtcaagaaggtggtatcgcggatctgcagcaagcgctgcttaagcagtgtgaaaacttgccagatgtcgtgcaatgcccgccaccgaagcgtttcgaacaagcgtatcagccaccccaattggacgagcgagagctgactgcccgtgagttaagccaagcgattgatcgccgctggcgagtgaccagttactcaggcttggtgatgcaatcaagtcatgctcgccatgatcctttgcaagagttgcccttgcttgaagtgggcggttttgatcttgatagtgcgcaagagcgtgatggagcggcgctggaatctgtcgagcgctcgattttcaatttcccgcgtggcgcacgccccggcacgttcttgcattcgctgtttgaagaggtggatttccagcaatcggcacacagtgaacccaatactaaaatcatccttgaactgatggaaagtgagcagattgaaagcgagtggctgccggtgttgcaacagttggttgacaccgtattgagcacgccactggatggtaaagcgctacgcttacaacagattatggccgcccagcgcctgaccgagttggagtttttactgccgatcgaagtgttggatgcgccaaccctgaatcgcatcacccagcgtcatgatccgctttcggcacacgcgggcgatctcggttttcatgcggtgcaaggcatgctcaaaggctttatcgatctggtgtttcaatatcaagggcgctattacgtgctggactggaaatccaaccatttgggtgacgatcctgcggcgtatcatccacagcgtttgggcagtgcgatggccgagcaccgttatgatctgcaataccaaatttatgcattagcgctgcatcgctttttgcgcagccgtttagcccattacaattacgagcagcatttcggcggcgtgttttatctctttttacgcgggatggatggccgcggcgatcagggcgtgttccataccaagccaagtttggccttgttagatgagttggatggattgattgcagggcgtgagttggcgcaaagagcgagtaaagctgggcagatggagcttgatttatgatgttttgggatagcgaagtagcgaaacgtctgctggcacaaggcgcgctgcgtcctttggatgtgcagtttgcccgctttattggcaagcaagccgtattggcagggcacaacgctgcagaaagtgagcttttgagtgtactgagcgcggcgctcagtgcagaacttgggcgtggacacatctgtctgccactgtgtgatgcacagggtaatcgttgcgatctagcggcgctgattggtctttatggtgaagcgagtttgcagcacagtgaacgctggttagcggtagactggcaagccttactgcaagcctcgccgttggtggggcagcaaggtgaagcggtgccgttaatgtttgatggctcaaggctctatctgcatcgctactggcattatgaaaagcaactggcggcgcgattgactgagttggccgcaccccaacgtttaagccctgctgaactggctaacttgcgtgaacgcctgaataccttatttgcccgcgactatttaggcttgtggcaagcactacaacaaaagccgctaagttcggtcgagcggattcaactgctgaatgatcgattggatgttgtggagtcggatgcgctggattggccagcgattgaagctgtagtcgaaaaagcgcagcgtgccgcggatttgcaagctttagagcagcttattccgcttactcactgcttaaactggcaaaaagtggcggccgctgtcgctcttacccgccgttttgcggtgatttccggtgggccgggaaccggcaaaaccaccacagtgaccaagcttctggcggcgctgattagccaaagcatggcgcaaggtaaagtgccagagatcaaattgatcgctccaaccggtaaagccgcggcacggttaaccgaatcgatgggtaaagcggtgagtcagctggcgatagagcctgagatcgccgcggcgatcccgagctcttccagcaccattcaccgtttgcttggcgcgattccgggcagcgctgagtttcgtcatcatacacgtaatccactccatcttgatctgttggtggtggatgaagcgtccatggttgacttgcctttgatggtgaaactggtcgaagcgctacccaagcacgctcggttgattttgctcggcgataaagatcaattggcttcggtggaagcgggggcggtgctcggtgatatttgtaccttcctgaaccaaggttacggccatgagcagggcgcgcagttggctgaactgacggggtttgccactctgcgccaaactgccagtaaaacggtaaacccggtggcggattgcttatgtatgctgcaaaaaagctaccgttttgatgcgcgatctggcattggtcaattggcgaaagcgatcaacagtggatctccggcgcgcgttgaagcggtgtggcaacagtcgttcagcgatattgaacactttgcccttagtggtgagcattatcagcaactgctgcaaaccttagtgcaggcttatcgtccttatctgagcttgcttaatcagccaactgagcaatttgagtcgacccaacaaagcatgctcacacttgccaaatcagcacttgatgcgttcagtcgctgccgattgctctgtgcgctgcgtgaaggcgattttggagtgatggggctgaacactcgcatcgaacgggcgttgaatgctcacaagctgattaaaacgcaagaagagatctggtatcacgggcggccgatcatggtcacgcgtaacgatcatggtttggggttatacaatggcgatattggcttgtgtatgcgcgatcgtgacgatgatcagggcagactgaaagtctattttgagttgccggatggcagcattaaagccgtgttgccgagccgagtcccgcaacatgaaaccgcgtatgcgatgaccatacataaatcgcaaggcagcgaatttgatttaactttgctgattttaccgccggattacagtccgattctgacgcgtgagttagtttacacggggatcacaagggcgaaaaaacagctcaaattgtgttgcgataacaaggtattgcagcgagcaattaaagtgaaaacccaacgggcgagtggcttagtggcaaggttggagcagtaaatgctccgccattccgtggcggcacagcattaaaggttggcaaaagctttagtaaaggtgatgctgcggatctggtaacgttcacgcgattggagcagaaacgttttgagattatcactgacgggaaatacgcagtgcacatcaagcccggagaggaactcagcgtcagccatgtcccaaaagctttgtagagaattacaaataacggttttcatagacgatttgctcttagatacggaatgtactcataaaagcaatccatgcgtgaattgagaaagatctcaagcgtcaaatcctgactcgatgattgaacaacatttaatcaaacgcgcgcattctaccgatctatctcacaaaataaaagcgaaaatcgaagaaaaaagatgcaacaatttgcatcttttgttcacttctgttcacacgcttttcaacttgttgaatttaaagctgcagcatcaaaatttttgagcggcgttggtagttgtataagctctttttcgccatcggtaacgcttcgacatcgacttcattgaaaccttgttcacggaaccagtgtgtgctgtgagtggttagcacaaacaggtgacgaatgcccatttgcttggcttgatgcttgctgtggaccaataaatgcaatccgcggtgaccatcacgatattcaggatgaatcgcgacacaagccatctcagccatgcgttcttctggataagggtagagtgccgagcagccaatcactaagccatctttgtcgatgatggtgaatttatggatctcttgctccaactgttcacgagagcggcgtaccagaatgccttgctcttccagaggacgaatcaaatcaaaaataccgccgatatcatcaatcgtggcttggcggatctgctccgcactcgccattacgatctgggtgccgataccatcaaacgagaacagctcttggattaatgcaccatcttctttgtaactcaccaagtggctgcgtggcacacccgcgcggcaggcttttaaagcggcgcgcaaaaaacgcatggtgctgaaacactcttcatcatctggtgcgcactcttgctccatgcttttgacgaggcgctctacatcgcttgggaagagttcggcaatcgcgttgcctttggtatctatgatcccttgctgtgggcaaaaaccgatcagcttatcggctttaagttttatcgccacttgggtcgccacttcctcagaaagcagattgaaacactcaccagtgacagagctagcaatcgggccaagcagcacaatcgaacctaaatccagcatacggttgatgccttccacatcaatccggcgaatgcgcccgctgtggcagtaatcgacaccttcatctatacctagtggttgagagatgatgaaattgccgctcacaacgttgagttgagtgcccgccattggcgtattgttgaggctcatcgaaagacgcgcagtgatcgcgtgttgtagttgtccggcggcttgcatcactaagccgagtgaggattcatcagtgatccgcacccctttgtggtatggcgtatcacgttgatttttttcaaggatttgattgatttgtggccgagctccgtgcacgagtaccactttaacgccaaggctgtgcagcagagcgatatcgctgatgatgttaggaaaatttttatcggcaatcgcttctcctcccagcataacgaccatggttttcccacggtgggcattaacgtagggcgctgactggcgaaatcctttgacgagagcggtactgcgaattttcacggctgaacatccttggtgtttaaatatgcgcaaataatgactttttattcttttttgagcaagcggttttttatatgaccgatagaatccttggtttattgcagacccgtttattgcaagccctatgggtcaaaataaatcggatgtaaaacagaaggatgacaaaagtatgaacagtaaggttgaacgctgcatcaatctgtatgagcagtgcagttaatggtgcaaagcctcgccccaagaggctggataaagtgagataagcggtatggcaaaaacggaaagcaaaagtaaagccttgagtaaagagcgtttactgctcttgctcgcgattttaggcacctcctacgttttgatgctgtacagcaacatctttggtcgtctgcaagagcagtggtttcctaagtctgagctatatgggatatgggttgagcagaatgttgccccttatgcggcacaaaaaatcaccattggcactcaaggtattgtgctgaatgggcgtttagtcaccacccattttaactacgatggtgctcgactcgaatttacggtgaatgggcagccgtatcagtttgagatcatgctggagaaaaagcagatgaaacagcgttcgtccgctaactatcagccggtttatcaattgtcagaaaaagtaaaaaataatcgctattaatcaaacgccaattgcacagtttcactgactttgtcatgctcttggcaaacataaaccatggacctcttttgtgagtaaacgtcttctttctctcgccagtttggcactgctgtttggttgtgctcagcaacctaacgatcgtgctcagcaataccaacaacaaacttttccacacattttgaatcgtgccgatgtggttgaatccaataagccgcgtgactataccgaattcagtaaacagagtgagttggtcgtgcaaggctcagcctccatggccaagatctatcgaccgctgtatgaacaattgaatgagtgggttctgcaaagcggagatcctgccactttagcgcaatttggcattcaagcagcgcagttaggtggcggggataaacaaggtaatgtattgtttactggatatttttcccctgtgattgagctgcgtcatcaacccgacagcgtgtttaaatatccggtttacggcttgccaaaatgcaacaaaaactgccccactcgagcggagatttaccaaggtgcgctggatggtcaaggtttagaattgggctatgcggagaacttgatcgatcctttcatcatggaagtgcagggcagtggctttgttcattttggggatgacgatactttggaatacttcgcttacgcgggtaaaaataacaaggcttacgtcagcattggtaaagtgttgattgaacgcggtttggttgagcgcgagaaaatgtcgctcaaagcgatcaaagattgggtgctggccaacgatgaagcaaccgtacgtgaactgcttgaggaaaacccttccttcgtatttttcaaacccagcgccgcggcacctgtgaagggcagcgccggcattcctttattgccgatggcatcggttgctggggaccgttcaattttgcctatggggacgccaattctagcggaagtccccctgctgaatgccgatggcacttggtctggcgcacatcaactgcgtttgttgattgtgcttgatacaggcggtgccgtgaaacaaaaccatctcgacttgtaccacggtatgggaccacgtgcagggttagaagcggggcactataagcactttggccgtgtgtggaaactcgggttagaaaactcgcctacccaagcaccatgggcattgccgccggaaaaacagcaatagtttttcctgatattgtgccggtagcaaactggacatttttgtgaagagtgcgtataaatcgcactctttatttttcagctagagtggaaatgtggttatgcgtgaactcgatactcctgcctccgacagttacaaccaacgttttggtggtacgcgccgtttgtatggttatgacgaagtcgacattttacgtgccgcgcacgtgtgtgtgattgggattggtggtgtcggttcatgggcggtagaagctctggcgcgcactggtattggtgagttgacgttgattgatatggatgatgtgtgtgtcactaacatcaaccgtcaaatccatgccatgaccgggacgattggcaaaagcaaaattgaagtgatggcggagcgcgttaagctcatcaatccagagtgcaaagtcaatttggtggatgacttcatcacgccggataatcaacatctttatctcaataaatcctttgattatgtgttggatgcgattgacagcttgaaagccaaagcttctcttctggcttactgccgcagcaacaaaatcaaagtgattacagtcggaggtgcgggcggacaaaccgatccaacgcaaatcaccgtggccgatttgaccaagacgattcaagatccactggcgaaaaagctcaaagatcgcctgcgtcagcaccacaacttcccaaccaatccagcgcgtaaatttgggattgattgtgttttctcgaccgagcaactcaaatacccacaagccgatggttcggtatgcgcgaccaaatcaaccgcagaaggtccaaaacgtatggattgcgccagcggatttggcgctgcgacggtagtgacggcgacgtttggttttgtcgcggtggcgcgcatcgtcgataaattgattcaaaagcataaagtgaaggcgtgagggcatgatgagtccatttcccgctcatccctttggtgatgacattaatgcacaaaccgtcttagaaaccatgcaaacattgcgcggttgggaagatcgttatcgccagatcatccaatggggcaaactgctgcctgtgatgccagaagcgctgaaaagtgagcaagttcttgtctcgggctgtgaaagtgaagtgtggctagtggcagagcagcaaggtgagcagtggtttttctgcgcggattccgatgcgcggattgtgcgcggtttgattgcgattgtgttggcggcactgaatggcaaaacgtctgcagaaattagcgcgttttctatggatgactactttgccgagcttggcttgctggcgcatttaagcccatcacgcggtaatgggttgcaagcgattgtggcgacgattcaggccaaagcgcatcactaacgacatactttttccaagcaaaagagcctcataaccatgaggctcttttgctatcagttctgccgatgtttacagtaaatcgaccgctttatggatggcggcgatcaagcgttccacctcttctgcgctgttgtacactccgaaagaaattcgcaccgtcccttttacgccaaaggcatccatcaaaggatgagcacaatgatgccccgcacgaacggcaattccttgttgatcgagtaaggtggcgaggtcttgatgatgtacgccatccatcactaagctcagtacactggcgttaggctgataaccgagcacgcgaatatcatcgatttgcgaaatagcttggtaagcttgctgttgcagttggtgtaagtgcgcttccacggcggctcgatcaagactttgataccagtcaatcgcggtggccagagcaatggcacctgccacattcggcgtgcctgcttcaaattttccgggcaagccggtaaaggttgtaccatcaaacgagaccttttcaaccatcttgccgccgccatgccaaggtggcatggcttctaaaagcgccgttttgccgtacaacacaccaatccctgctggcgcatacagcttatggcccgagaatacatagaaatccgcatccagcgcgcgaacgtctacggtttcatggactatgccttgagcgccatcgatcaccacaatcgcgccttgttgatgtgcggcttggatgactgcttcaatcggctggcgagttcccgtgacattggtgatatgggctagggcaacgattttgcagcgtggtgacagcaattgccgaaaggcagcaaggccaaattcacccgttgttgtcatcgggattttgaccactttcgcgcccgtttgctcagcgaccatttgccacggcacgatattggcgtggtgttcagtttcactgaccagaatctcatccccagcttgtaatgtgctgcgggcataactttgtgcaatgaggttgagtgcttcggtagcaccgcgcgtccagataatatttttgctgcttggcgcaccaataaattgtgcgacttgttcacgcgcgccttcaaattggctggtggcttgcgccgtcaaactgtggctaccgcgatgtacattggcattgtgctggctgtagtagtggctgatggcatcaatcacacattgtggtttttgcgtagtggccgcactgtcgagatagaccagcgggttaccgttgacgatttgttgcagcgccggaaactgcgcgcggattgcatcaagattgagcatcaataaaacctgaaagttcggtcagttgttgaggatgaagaaccatgggggcggcaacgtgttgcgccaattccacgcctgcgagcagtgcaatcatggcgagcgcaaactccagagcggtgcctggcccttggctggtgagtaaatgttgcgtggcatagtaacagacgcgctgacgactcagacgctctgaaggaatatggtcaaaaaagttggggtgacaagtcatgcgtgcgccgacaaatttctgctgtttggcgaaaaccagtgcaggtgtcgcgcaaattgcggcaaccagtttgccttgttgtgagaacgcatcaatcagtgcaagtagcgcagtactatcggcaaacgcttgcgctccgcccacacctccgggcagtgccagtgcatcaaacgcttctgccgagcacgcttcaagcgtctgctctgccgtcagccaaacaccccgtgagccttgcacttgtaacttgtcgccgaccgctgccatggtgacctgaaatcctgcgcgcaccaaagtatcgacgatgatgacagtttccatctcctcgctgccatgggcgacggggacgagaattcgtttgctcatgccttgctccaactctgctctaaggttttgatttgttgatataacgcgctgtttaccggagttgcaatgccatgctgttcgcctttgcgtactacgtaaccagtaataaagtctatctcggttggacgtcggtggaaaacatcttgatgcatggaggagagattggccgccgtagcttggattacttgataaaccccatcacgcagtgcttcagcctcaccgcttatcgcttctgcctgcataacggctgtcacctcatctaaaatggcagtgatgatcggcgtaaattcaggtgcaactaatgcaccgttggcgcattgatgaatcgcggttagcggatttatcgcgcaattcaccgcgagtttgcgccacaaagcctgttggatctctggattccatgtcactggagcgagtgcgtgattaaaaacgtctgcgataaaatcacaacgtgcaccgagggcattaaaaggacccacttgggtttggccgaatcccgtatgactcacttggttgagcgtggcttttagcgcgccatgagtggtggttgcaaacaataccggaaagtgagtcaaagattcgcttatggcttcgactgcgcccatgccattgtgcataaacagcaaaatggtttctcgattcagatgggggagcaaaggctgtaatgccgcttccacttgccaagccttgacggtgatcagcagtaaatcggcatggatgagcgtgtctaaattttgattacgaaatgaaatgggcgcttcttcatcgagctggagcgttatggtcggctgagcttgacggctccatagcgcgacttgatgacctgcactatgtaagtgcagcgcccacaaagagccgaccgctcccgggccaagtaccacaatattcatctctgtcccctgctgaaaatcgaatgcgccaaggataacgaggggagttttgaaagcaataaaaaatggcgcgaagtcgcgccatttttactgtttaggctctttcctgtttaggaaggagcgtgcagatgtctacaattagaacttgtaagttactgctacgtagtggccaaagcctgttgacttgaagccatcggtatctttgattccgtaaacgtctttgtagccttttagaccgtagcctacagcgaaacgatctgaatgccagtagataccgttaaacatcgcaccgccgttgctggctgtcgagtattcatctttaaggccgaattggtaatcgatataaccttggtaagagatgaatgaaccgttctcgaagaaatagaaaggtttaaaccagttggtcgagatttggaagccgttccaatctttgcggttgccatcataagtaccgtataggttcaggccaactttgccaaaccatggaaccatcacatcagaaccaagaccaattttctggttgtttacagaaaatgcgttggttttaaaatctgtaccatcccattcgaacagtgatgcaacgtaaacttcttgtactggaccgaaagacatatcaacgccagtaaatgcatccagagacatacgtggagcaaacttcatgaagatttttggatcgccaactttgtcactgcttttgttcgttgctaagttaaacacgtcaacgtaaccgtacagatcaaagataccagaacgaccgccaaattccatttccagataatcatgagatgatttgcctggaagttcgtcgaatgcacccatcaggttaaattgcatccacttgtaatcgtttttgtggatatcgccatctgagtagtcagcggccagaacaggtgctgaagttgctgccaataggcttaaagcaagaagtgatttacgcataaggggaactctctgtaagtgtgttgtgtatggcggccgcataactgcagctcgttcaactggcgggcataataacgataaaaatcgcaattaaaagtgataagaagtgcaaaattaaaggcattgagtgatagcaatcacacctttgttaattaattttgaacttattttgtatttcacaattttgcatttttattgtgatcttaatcgctttggttgagagttgactaaacttatacgctaatcgataaaccaacaaattcagtgagtgatcgacgaatgaactcttttcgtatacctaagtaaatttatgaaaaggagtgagtaatggaagagataatgttgtttccacttagctccgtcgtacttcctgaagggaaaatgaagctgcgaatttttgaaccgcgctatcagcgtatggtcgctcagtgcagtaaaacgggcagtggatttggtctctgtttgttcgatagtaagtcgaataaaaatgcaaacgaattatctgagtttgggactttagtcaaaatcgttgattttgaaacgttaagtgatggtttgcttgggatcacagtcgtcggtatacgacgttttgcgattcgcaaagttcgggttgaatatgacggtttgcggattgctacagtacagtggtttccggattggccaagccaagaattgttagagcgggagcgctttttaggcgagcaattgcaggaagtctatcggcaatttccacaaattggtgagttgcacagtttgtgcttttttgatgatgcgagctgggtctgtcaacgttggctagaactgctacctttaagcaaaggacagtttgatgtgctggttgggcagcgagattgccatgcagctttagcttttttacagcgtaccattgagtcgcatctcgacacgtgaacaatttgcttgtggcgaatgatctcaagtggtaacactgacgtataggcttactagggtgttcgcctgagtcattaaggatgagtttatatgtttaatccatcacctcatacgtttggccgccaagagtggctagagtgtatggaaaaagttaaaagcagggacacacaggcttttgctctggtatttagctattactcgccgaaattgaagcagtttgtgatgaagcatgtcggtagtgaacaggtagcgttggaattggttcaagaaaccatgtcaaccgtatggcaaaaagctagtctgtttgatgggcagaaaagctctctcgcgacttggatttacaccatagcgcgtaacctaagttatgacttgttacgtcgacaaaaggggcgtgacgcttatgtgttggccgatgatatttggccggaagattattgtcctcctgatctggttgatcactacgcaccggaacaagatctgctcaaagagcaggtgatgaaatttctcgaccgcctgccagaagcacagcagcaagtgatcaaagcggtctatttagaagaaatcccccagcaagatgtggccgacatgctcgacattccactcggcactgtgaaatcacgtctacgtcttgcggtagaaaagttaagattatcaatggatgcggagtccttatgagttatcaccctaattatgctttactcgcagcctatgctgagggcggtcttgattctgcgcatggtttggcgatttctgctcatttggaaatctgcccacattgtcgtgacttggtgcatgagattgaggcagaacttggtgagttactcaatcagcaagcggcctcttctgtcgccttgtcagacgatgccaactggcaagcgatgttcgattcgattgtggccttgccgcagcaagcggcatcgaacactcccgttaaaaccacaccggtaatggtgacggtaaacggtaagcagattgcgattcccaaagtcttagcgcgtttggttaaacctgagcagcagtggcgcagctacggtggcaaagtgttcagtttacctttgcagtcggaagataatgtacggatgaatctgatgtacatcagccaaggggtttctattcctcagcacacccataaagggtttgagtcgaccttggtgttgcacggtggttttagtgatgaaaatggtcattacgatgtgggtgattttatgcagcatgatggtcaaatctgccattcgccaagcacaccgcaagatcaagactgcctttgcttaaccgtattgactgagcctatggtctttacccaaggggtagcgcggatctttaacctgtttggcaagggactttacccgtaaccgttaatgagcttgaaaataaacaagggagcgatgaagctcccttgttggtttagtgaagggtttatttggtgaatggtgtgcgccttactggatgattttatcctcaggcggtaactcttctttatgctgcttcgcgttttctagcatcttagtgaagtcatgacgtagcgagtaaagcatgatcaaacttgggatcaccattaccgcggtcaaaatgaagaacagtgaccagtcgttcagaaaatccgctaactcaccactaaacgaagcgatagtggttctgcctaaattacctaatgaagccagcaacgcgtattgcgtggcggaaaatgcctgtccagtcattaaggtcaggaaggaaacaaaggctaccgttgagaaggcagaagtgaagttatcgacgaagagagtcgctaaaaataggtgctcattcggaccgactttggctatccaagcaaacatcaagttactagacgccatggcgatgccaccaatcattaatcctcgcacaataccgaacttgatattgactaagctgccaagcaaggtgaacaaaatggtgataccccaaccgagtagcttagagtagtagccaatctgttcgttgctaaaaccaatttctttgtaaaaggcaatcgacatgcgtcctaagaaggcttcgccgattttgaacagaaagacaaacagcagcagtgtcagcgcaacacgaaaaccattacggcggaaaaagtcgataaacggctctaagaccgtgacggttaaccaactaagcaccggattgctgacaacctgttggtggcgttcttcagcaagttgctgtaattgatcccgctgagtgtgtggctcacctaccagcaaggtaaacaacatcaataagccaaccactcctgccataatgtagtaaaccccattccagccaatgctatcggcattgacgaaagcgaagtagccgggaagcgagtaacccgtccaccaaccgacgaccgccatggcagatgcttgtggcaatttggttgattcactttttgggaaggtatctatccggaaggcatcgacagccacatcttgcgtcgccgaggcaatcgcaatccccaaagcgaacatggaagtcagcataagattgttggctgggttaacacctgcgatgagtaacgtacagactagaacgatggattggcagaaaaagatccagcttcggcgctgaccaagcatcgaatgtagaatgggtaacttgactctatcgaccagtggtgcccagagaaagttgatcgcgtataccgcaaacacactgccaaaatagccgatggcagcgcggctgagtccggcatctttcagccagccagtcatgttggaaccaatcaatacccatgggaagccgctggcacaacccagcataaatacccagagcaagcgtcgatcaaaatagctaacaataagttctagccaagaatgggaccggggttgctgaaccataacgagtccttttgcatgtgattatgatgattgccgcactcccgagttcaggagtgcggtgaggcagtttaaggtaagcgagtgactttattaatgacgatgggtgtgacaggaacgttctgcattcgacctttattttgagtcggttgctgagccattttttcaatcacatcaaacccttcgatcacttgaccaaacaccgcatagcccggcggctttgcggcatagttcaagaaatcattatccaccaagttaatgtaaaactgtcttgttgccgaattcgggttttgcgtacgagccatggcaatggtcgcggtatcattacgcaagccattgctggcttcattctcgatcggggcgtaagtcggtagctgattaagataagcatcaaagccacctccttgcgccataaagcctgggatcacgcgatgaaattggctgccaacatagctgccgtcatccacatagcgtaagaaattcgcaaccgagatcggtgctttttcttgattcagctcgatcgtgaaattgccgagtgtggtttccactgcgactttgggacccgcccacacgcaactgctgaccagtgctacggttgccaatagccatgacttagccattaaagcgctcctgcatgtagttttgcagctcggcatcgttagcgatctctttgagcacagtgttgatcacgtcattgagtacggtttcaatttcatcgttagaggcactgagaacgccagtacgttttgcggtgcctgtgtagcttttcaccaacttgcctcttggtgtttcagccgtgatttccaataccacgctgccatccatttggttttccatgattgagtgcttcacggagaccaaaagttcttggatttcgagagtgatggtgttttcactattgacgctgagacggaaaccttgcgatccaaactgttcagccagggcgttttctagcgtaatgcgcacattttggcgtggatgaatgggctcaatattgttacgaccactatcgactaaagccacatattgcgctgaacgcacatctttgctgaccagcgaaaagctgctgttattcacaatcgcattttggcttaatgccgcttgagggttaacgttgatttgactctgctgaggagcagaacaagcggtaagtaaagcgattgaagccgcaagaaccagttttttcatggttaattcctttcgttttattgtgcacacagccgcaaggctcaagatttaatagcttgtaagataacaaatttactgttgttggcgatcactctaacatgacttttaccaaacaatcttgccagttttacatcgtagccgaggtggcgattgccgatcacccataatttcccgccttttttcagaacatgctttgagtcacagaacatttgccacgcgatgtgatccgtaatggtttgttgttgatggaacggcggattacacacaatcattgaactactgtgcgctgggaaaccatccagacagttgttggcgatacagtgaatatctcgtttaccgagattgtcgtgtaagtttttttgtgcggaggcgatcgccataaagctttcatcaacacaggtgatcttcgcttgtgggtttaattgtccgagacgaaccgataacacgccattgccacacccaagatcaataaagtcttccagagtcggatcggctggcaaatgctcaaggataaatctggaacccagatctaaactttcacccgaatacacattcggtaagttagtgagggtgatagcataaggctcaatgctccaaccgcattcagggttaacctcattagcgggattcaccgtcgcagaactgaacactaaacgatgttttttccacgccagcgaagtggtggtggggcctagatgcttttcaaacagattcaaggttgatgtatgaatctccttcgctttattcaccgcaatgatcgggatgttcggcgaaagggctttacgcagttggctcaggatccacaccagatgacgattactcttgggcagttgcagtagcacgacagaggcatcattagggaccggatccaacgtcgtcagtaactgaactggcggacgctgattttgctgcaaattcgcttgagtcgcttgatgggcaatgtaggagtcactcatcatgctgactttatgtttttgactaaaccaacaacttaaagtgccgaaatggtcattaatgatcactatatggctagattctgggagggcgagttgttccacatgctggatgaggtactcatcgccggcatcccaagcttgcaaagtttcgttattgcgctttgggaaacgatgaagagtgagcgtctgctcaagcaaagtaagctcagttttcatattgctcgtgtttctagtaaattgacggcgcattgtctcagatggcaataaaacagcaaatgaaaacctaggtttttgcatttttagccacacgcaagacccgctatggtctattctcaatttgtcatgttgtcgacactcaagtgttcaacaaggaaagcaatatgattcaagatgttattgaaaagaagctgagtgatgaatttcagcccgagtttctgaaagtgattaatgaaagtgatatgcacaacgtgccgcgaggttcggagagtcattttaaggtcacagtagtgagtgaacgctttgccggcctgcgtcctgtcgctcgtcatcgtttggtcaatcaaaccttggcggatgagttagcgaatcatatccacgcgctcgccattcatacctacacgactcaagagtggcagcaaatgaatcaggaaagtccagaaagcccaatgtgtttggggggctcgcgcaaaagcgctcaatgataggtttgatacctataacgcttgattggattttgagcaaattattaacacggtttaaacaaatgagttcgaatatttcaggttatgcaggggtttagtggcttaagtcagtcaataggcccacataaaataggccttagtgagtttgtgcgatgcttcaaaaatatgatgatttcttagcctttcactccggattcgtttgaaattaaacagtgattcagggcattggtcatggcatcaagttcccaaaagatgctagactacagcacctgacaaatcccccacatgatttgtgatgggatttttaaaaggatgttgcgattttaatggttcaagccattaaaaacggacacaaacaatgtcgtgtctaccgaggtaaggattccgctagcgttgttcagttgtaaggacaaggcaaacggagtgcgcctcgaatttgcgcaatgaaagaatctttttcccgataaaagtagtgcaagtgcgtatgattacaataaaaaagggattggaccttcctatcgcaggaactccttcccaggtgattagtgatggtaaagccatcaaaaaagtcgccttgcttggcgaagagtacgttggcatgcgtcctactatgcatgtccgcgtaggtgatgaagtaaaaaaagctcagattctttttgaagataagaagaatccgggtgtgaaatttacttcaccagtcagcggtaaagtggttgaaatcaatcgtggtgcaaagcgcgttcttcagtctgtagtgattgaagtggcgggtgatgaccaagtgaccttcgacaagtttgaagccaatcaattagccagtttgaatcgcgatgcgatcaaaactcagctggttgagtctggtctttggactgctttccgtactcgtccgttcagcaaggttccagccattgattccacttctgaagccatttttgtcactgctatggataccaatccgttggcagctgagccgaccgttgtgatcaatgaacaatctgaagccttcgttgctggtctagatgtgctttccgcactgacaactggcaaagtgtacgtttgtaaaaaaggcaccagcttgccacgttctcaacagccgaatgttgaagaacatgtctttgacggcccacatcctgcaggcttagctggcactcacatgcatttcctctatccagtaagtgcagaccacgtggcgtggagcatcaactatcaggacgtgatcgcagtaggtcaactgttcctgacgggcgagctatacacccagcgtgtggtttctcttgccggcccggtggtgaacaaacctcgtttggttcgcactgtcatgggcgcatcactagagcaactggtggacagcgaaatcatgcctggcgaagtacgcatcatctctggctctgtgctgtctggtacgaaagccactggaccacacgcttatcttggtcgttaccacctacaggtctctgttcttcgtgaaggacgtgataaagaactgtttggttgggcgatgccgggtaagaacaagttctctgtgactcgctctttccttggtcacctattcaagggccaagtgtacaacatgaccacaaccactaatggtagtgatcgatctatggttccaatcggtaactatgagaaggtcatgccactagatatggagccaaccttgttgcttcgtgatctgtgtgctggtgacagtgacagcgcggttcgcttaggtgctttagagctggatgaagaagatctagcactgtgtacgttcgtttgcccaggcaaatacgagtacggtcagctcctgcgtgagtgcttagacaagatcgagaaagaagggtaatttccatgggccttaaaaagtttcttgaagacatcgagcatcattttgagccaggcggcaaacacgagaagtggtttgccctgtatgaagcagcggcgacgctgttctatacaccaggtctggtaaccaaaagaagctcgcacgttcgtgatagcgttgacctaaaacgtatcatgatcatggtttggcttgccgtattcccagcgatgttctggggtatgtacaacgctggcggccaagctattgcagcacttaaccatctgtattcaggtgatcaactcgcggcgattgtggcgggtaactggcactactggctaaccgaaatgcttggcggaaccatgtcaagcgatgctggttggggcagtaaaatgctgttgggtgcaacctacttcctacctatctacgctacggtgttcatcgtcggtggtttctgggaagtgttgttctgtatggtgcgcaagcatgaagtcaacgaaggtttcttcgttacctctattctgtttgctctgattgttccgccaactctgcctctgtggcaagctgcactgggtattacctttggtgttgtggttgccaaagaagtgtttggtggtacaggccgtaacttccttaacccagcgctggctggccgtgctttcctgttctttgcttacccagcacagatctcaggtgacctagtatggactgcggcagatggctactcaggcgcaactgcgctgagccaatgggcacaaggtggtgcaggtgcactgattaacaacgcgactggtcaaacgatcacttggatggatgctttcatcggtaacatcccaggttcaattggtgaagtgtctactctggcactcatgattggtgcagcgttcattgtttatatgggcattgcttcatggcgcattattggcggcgtgatgattggtatgatcctgctgtcgacactgtttaacgtgattggctcagataccaacgcaatgttcaacatgccttggcattggcacctagtattgggtggtttcgcattcggtatgttcttcatggcgactgacccagtttctgcgtccttcaccaatagcggtaaatgggcttacggtattctgatcggtgttatgtgtgtgctgatccgtgttgtgaacccggcttacccagaaggcatgatgctggcgatcctattcgcgaacctatttgcgccactgtttgaccatgtggttgtagagagaaatatcaagcggagattagcgcgctatggcaagcaataacgatagcattaaaaagacgctgtttgttgttatcgcgttgagcctagtgtgctcaatcattgtatcggcagcggctgtcggtctgcgtgacaagcaaaaagaaaatgcggcattagacaagcagagcaagatcctgcaagtggctggcattgaagcgaaaggcagtaaacaaatcgttgaattgttcaataaaagcattgaaccacgtctggttgacttcaacacgggtgactttgttgaaggcgatgcagctaactacgatcaacgtaaagcagcgaaagaagcctctgaatctatcaagctgaccgctgaacaagataaagcgaagatccaacgtcgtgcgaatgttggtgtggtttatctggtgaaagacggcgacaaaaccagcaaggtgattctgcctgtacacggtaacggcctatggtcgatgatgtacgcgtttgtagcagtagaaactgacggtaacacggtttcaggtttgacctactatgaacaaggtgaaacaccgggattgggtggcgaagttgaaaacccagcttggcgtgctcaatgggtcggtaaaaagctgtttgatgaaaaccacaaacctgcgatcaagattgtcaaaggtggtgcacctcaaggttcagagcatggcgtagacggtctgtctggcgcaactttgaccagtaatggcgtacaaaacaccttcgacttctggttgggtgatatgggctttggtccattcctgacaaaagttcgtgacggaggtcttaactaatgtctagcgcaaaagagctgaaaaagagtgtgttagccccagttttggacaacaacccgattgcactgcaagttctgggtgtgtgttctgcactggcggtaaccactaagctggaaacggcatttgttatgacgctagcggtaatgtttgttactgcattgtctaacttcttcgtttctctgatccgtaaccacattcctaacagtgtgcgtattatcgtacaaatggcgattatcgcttcgttagttatcgtggtagaccagattctgaaagcgtatctgtacgatatttctaagcaactgtcggtattcgttggtctgattatcaccaactgtatcgtaatgggtcgtgcagaagcgtttgcaatgaagtctgaaccaattccttctttcattgatggtattggtaacggtttaggatacggtttcgtgctgatgacggttggtttcttccgtgagcttttaggctcaggtaagctatttggcttggaagttctgcctctgatcagcaacggtggttggtatcagccaaacggcctgatgctactcgcaccttcagcattcttcctgatcggcttcatgatttgggcgattcgcacgttcaaaccagaacaagtagaagcgaaggagtaaggttgtcatggaacattatattagtctgctggtgaaatcgattttcatcgagaacatggcactctctttcttcctagggatgtgtacattcttggcggtgtcgaagaaagttaagacatcattcggcttaggtattgcggtaatcgtagtactgactatctctgtaccagttaacaatctggtgtacaaccttgtgcttaagccagatgcactggttgaaggggtagatcttagcttcctcaactttattacctttatcggtgttattgcggcattagtacagattctggaaatgatcctcgatcgcttcttcccgcctctgtataacgcactgggcatcttccttccgctgatcacagtaaactgtgcgatcttcggtggtgtgtctttcatggtgcagcgcgactacagctttgctgaatcagtggtatacggtttcggttctggtgtgggttggatgctggctatcgtcgctcttgcaggtatccgtgagaagatgaagtattcagacgttcctccaggtctgcgtggtttaggtattacctttatcacggctggcttgatggcgttgggcttcatgtctttctctggtgttcaactgtaagtcgggtaaaccgcagcaataaaggaatagttaatgtctactattatttttggtgtagtgatgtttaccctgattatactggctttggttctggtgattctgttcgccaaatccaagctagtaccaacaggtgacattacaatttctattaatggcgatcctgaaaaagcgatcgtaacccaaccgggtggtaagttgctgactgcactggcaggcgctggtgtattcgtatcttcagcttgtggtggtggtggttcatgtggccaatgccgtgtaaaaatcaaatcaggtggcggtgatattctgccgacagaactggatcacatcagcaaaggcgaagcccgtgaaggtgagcgtttggcgtgtcaggttgctgtaaaagcagatatggatctggaactgccagaagagatctttggcgtgaagaagtgggaatgtacggttatctctaacgataacaaagccactttcatcaaagagctgaagcttgcgattcctgatggtgaatcagtaccattccgtgcgggtggttacattcagattgaagcgcctgcgcaccatgttaagtacgccgattttgatgtacctgagaaataccgtggtgactgggacaaattcaatctgttccgttatgagtctaaagtggatgagccaatcatccgtgcatactcaatggcgaactaccctgaagagtttggcatcatcatgctgaacgtgcgtatcgcgactccgccgccaaataatccaaatgtgccaccaggccaaatgtcttcttacatctggtcactgaaagccggtgataaatgtacgatttctggtccgttcggtgagttcttcgcgaaagacacggatgcagagatggtatttatcggtggtggtgcgggtatggcgccaatgcgttcgcatatctttgaccaactgaagcgtctgaagtctaagcgtaagatgtcttattggtacggtgcgcgttctaagcgtgaaatgttctacgtggaagatttcgatggcctagcggctgagaatgacaacttcgtatggcactgtgctctgtcagatcctcaaccagaagataactggacaggctacaccggtttcatccataacgtactgtatgaaaactatctgaaggatcacgaagctccggaagattgtgaatactacatgtgtggacctccgatgatgaacgcggcagtgatcaacatgctgaaaaacctaggtgtagaagaggaaaacatcctactggatgacttcggtggttaatcgataactcgctacactgcgatggctggctcgttcgagtcagccattgttttttacaaattggatattgaaagtgtcgatggttatctggtttagggtatcggtatttcccatatcaatttttaactatgaaaggagtaaacaagtgagaaattggcttgttgcattagcttctcttctcttgctggctggctgtgaaaagcccgcagagcaggtacatctcagtggcccaaccatgggaaccacttacaacatcaaatacattcaacagccgggaattgcggattcgaaaacactgcaaaccgagattgatcgactccttgaagaagtgaacgatcaaatgtcgacttaccgtaaagactctgagctcagccgttttaaccagcataccagtagcgaaccttttgccgtttctacacaaacgttaaccgtggtgaaagaggcgattcgtttgaacggtcttactgaaggtgctttagatgtgaccgtcggacctttggttaatctgtggggatttggccctgaagcccgtcctgatgtggtaccaaccgatgaagagctgaatgcgcgtcgtgctattactggcattgagcatctgacgattgaagggaatacgctgagtaaagatattcctgaactgtatgtcgacttgtctacgattgccaaaggttggggagtagatgtggtcgccgattaccttcaatctcaaggtatcgaaaactacatggtagaaattggcggagaaatccgtttgaaaggactgaaccgtgatggtgttccctggcgtattgcgatagaaaagccaagtgttgatcagcgtagtgtacaagagatcatcgaaccgggtgattatgcgatcgcaacctccggtgattaccgtaactactttgagcaagatggcgttcgttactcgcatatcatcgatccaactaccggacgcccaatcaataaccgcgtggtctccgtgacggtactggataagtcttgtatgacggcggatggcttagcgacaggcttgatggtcatgggcgaagagcgtggtatggctgtcgcagaagccaaccagatcccggttttaatgattgtgaaaacggatgatggctttaaagagtacgcatcaagcagctttaaaccgtttttaagtaagtaatagtgagcataaaacaatgaacacctttttgattacttttggtttctttctggccgtgattgccgccatggccgttggttacattttccaacgtaaagtggtgaaaggcagctgtggtggtttaggtgcagtgggcatcgaaaaagtctgcaattgccctgagccttgtgatgcacgtaaaaaacgtgaagctaaagcagccgcccgcgccgagcgtcttgcggcttgggaaaaagatcggatcgcataattcgtgctatcgcatcaaaaagctcgctccggcgggctttttgtttatcagactttccttatcgatggcttattattatactgtttatgtatacagtattggtgggctatgcaagacagaattcgtaaaatcatccatgtcgatatggactgctttttcgctgccgttgaaatgcgggataaccctgcgtatcgagagatagcactggccgtgggcggacatgaaaagcagcgtggagtgatcagtacatgcaactatcaggcgcgcaaatttggcgttcgttctgctatgcctaccgctcaggcattaaaactctgcccacaactgcatgtcgtcccggggcggatgtctgtctacaaaagtgtttctcaacaaatccaaactatttttcagcgttatacctcgttgattgagcctctttcacttgatgaggcctatcttgatgtcagtgaatcgactgcctatcaaggtagtgcgaccttaattgctcaagcgattcgacgtgatatctggcaagagttgaatttaacggcgtccgctggtgttgcgccgatcaagtttcttgcaaaagttgcgtccgacttaaataaacctgatggcttgtatgtggtgacgcctgacaaagttcaggagatggtcgatagtttgccgctggaaaagattccgggtgttggcaaagtggcgttagaaaagctgcatcaagccggtctttatgtcggagcggatgtaaggcgagcggactatcgcaagttactgcatcaatttgggcgtttaggtgcttctttgtggaaaaaaagtcacggcattgatgaacgtgaagtggtgactgagcgcgaacgaaaatctgtcggtgtggagtacacctttagccaaaacatttcgacgtttcaggagtgttggcaagtgattgaacagaaattgtatccggagctagatgctcgtttgagtcgggctcacccacagcgaggcattattaaacaaggcattaaagtgaaatttgctgatttccaacagacaaccattgagcatgttcaccctgcattagagctcgactacttccacgagctgttagagcaagtgttaactcgccagcaaggacgagaaattcgcttacttggtttaagtgtcatgcttaagccggaattgcagatgaaacagctatcgatgtttccgagtgatggatggcaataggccgatgcctctcttaaaacagacatcatggagtggggtgataaagagcgttatcctttcgtcgcctaatgcaaatcgtttggtatagtgtgtttgttattgatataccactctaaatgaatgagagagagttcaactttgggttcctttatcaggggggggatttgatgaattgaacaataaacggcaggaaagtgtcatttttgacgttttattggcgtagtattcatcaggattgattatagttggcaaaaaatcggccagagaacaccatgaaaaaatcgtttttaaccttagcgctattaatgagttcctccacttgggcggcacaatgtcaggtggatatccaaaatgaagtgcatcttaatactcaacgtattgagatccggcgtaccagcagtgataaagcgctgatcgataagcagaacaatctttatattcaaggtaagagagtttcgcttaacgcagatcagcaggcagcggtacgtcagtatcgtgagcagttgaccagtttactgccaaaagctcagcgatgggcagacgatagtttgaagctagccaatcagttagttgacgatgttgcactctctttagaggccccacaagcgtttaataatgtgaaaacctctatggccaccttgtttgctgaagcgaaagctgagtactttaaaaatggtgatttggttgttcccgctgaaacgtttgctgcaatgcaaactcgatggcaacagaaattagcgcagggaaaagaagtcctcacgcagcaattttttactagtgcgtttgatgtgatggcgaataaaatgcagcaggagggcggggtgaatcttagccagcttggtaaaaacatggcggatttaaaaaacaaattggacagcaagctaaaagaacaaagctcgacgtttgagaaacaaggacgagagtggtgtgatacgctgaacaaaatgacgcaacaagaacagcaattacacaaaaagatccctcaactaaagaactatcaagtcttcaccatctaaactgataagagcgtgacctgcgctcttttgttctaagtaaaggtttattatgacgatggtgatatgaatttaaataactttagcctacgctggctaacgacactcaatgcgttagcggtggtgttaggctttttaatgttttatctgacctttaaatatttctggtcacatgatcgtgaagttgcgcaagtgctgcagttacaacaggccgagttgcagcgggttgaaaccttgttgtcgttagaacgtaaggcgatgggggcttctttggcagattatgccgcttgggattaaatggcagacttcattgcaaaacccacccttgagttcacacaaagcaatattggagagcacgctttcagttcacaattcctcgatggcgtatttatctatgatcctgagggcaatttggtttggggcaagaaatatgacgcagcaacggggcagagctctagctatgagcacttattgccggatttttcacgtattttacagcaggcgacacgtttaagtgtggatgaaatctcgacttccgttcgttatatggtggtggaggatgagccctatttagctgccacggctcgtgtctgtgacagtgatgggaaagggtgtaacaaaggtttcttaatctttattaaaaaagtccgcgcccagtttgcgagagactgtaagatcttctgtgtaagtggctgtttatcatattgatacacggtcactattcataatcataaactgactcatggccgctttccaatctcttattggcattgtccacttcttcgatatctggtgaagcgccagatacagtattttcatcactgaatcgtcagtcgggaacgaccgtctggtcttggtgattttacgcaggctcgcgttcagggattcgatggcattcgtggtgtaaatgaccttacggatttccggtggatagtcgaagaagacacttagacgtgcccagttattacgccatgacaggctaatcgttgggtgttggtcatcccatttttcagcgaactctgccagagccagttccgcttcggccagtgtggctgcgccgtaaattcgtttaaggtcagcggcaataaccttacgttgtttccagttaacatagcgcagcgagtgacgaatttgatgtacgatacacagttgcacctgtgttttcgggtaaaccgcctcgatggcttccgggaagcctttcagaccatcgcagcaagcaatgaagatatcctgtacgccacggttcttaagttcgttcatcacagacaaccagaacttagcgccttcggtctgagccatccacaagcctaacagctccttttcaccatcagtgttgataccgagcgccaggtaaaccgatttgttctgtaccgcaccggaatcgcggctacgtaccaccaaacaatccaggtaaacgacgggatataatgcatccagcggacgttgctgccattgctttacctcatccatcacttcattggtaacttgagagataaaggttggagagacttctacaccatacgattcctcgaagtgcgcctgaatatcacgggttgtcatacctcgcgcatacaacgagataatccggtcatcaaaaccgttgagctgcttctcgccctttttaatgagcttgggttcaaagctaccattgcgatcacgagggatatccagctctatttcgccgtgaactgagcgaagttttttactggatttaccatttctggagttgccggaattcctgccttccggtgcatgtttagcgtaaccaagatgttgctccatctcggcgttcaacgctcgctcggcaacctttttggtgagctgttttagtaatccggcttcgccgaggatgtcatcgggggaatcatagccttctagaagctgatcgataagtttgtctgatattggcattctgtatttcctttcaacaggttaagaatgccacttacacagatatttttacactctcgtttgcgaatgtggttgagcaagccactggtgtcgatattgaagtcttaacctgtaaaaatgatgcgcccttaccgcaagacgaagtggatgtttcatacatcaagcaactcgattacagcggtaattccagtgtgttgtttaaaattaaccatcacattaagcatcctcccttcattcgaaccgaagaaattcttgctttgctgttcttttcactggtgatgtacttagtcaatttatgggtggtgattgccttgatcaaaccgatcacgaccgccagtcaagtgttgcaacaatttaaaacatcgggcggaaaaatgccggatgcgagtacttttatctcatcggagatgaaagaatttgccactacgatcaaccgaatcgtcggacaattggaggatagtcaacaagtgttacgttggcagtctgagcatgatccactaacccgcatttccaatcgtcgccatttagaaaagcagcttaaaagttatttgagcgatcgtccgcaagcctatctggtgctgtttcttgtcgatatcgattttttcaaacgtttcaatgacagctttggtcatttggctggcgatgaagccttatgttccgttgctgatgtgctccaatcggtggagttccatggcgagaaaatcgtggcgcgctttgggggagaagagttttgtgttgttttagcttcggactgtgcatttgatgcagaacagtatgcacaacagatgagaagcaaaatcgagcagctcgcgattgcaaatccggttgatgcactctgccaatatctaacggtgagcattggtggtgtgtatgctatttctccaaagatggagtcttatctctctttgttccatcaggcggatatggcactttatcatgcgaaagaacacggacgagatcgatacgttgtgcgaaattttgtctaaattttaaacgatacatcatttgaaatttgatttgagtcgataaaagtaaagtgattgggtgatttttcagcgaatgattctgttgctgattgagtcaatctccgctttgtattaatgtactagttaactagtgtgttggtatcgtgagtcgtcgtaatggcacaatcaaattctcgtgagacattcagctctcgcctcggttttattcttgcggctgctggagctgcagtcggtttaggtaatatttgggggtttcctactcaagcggccagcaatggtggcggcgcatttttgttggtctaccttattttgatctttgtggtcgccttcccgatgttggtcgtggaaatggcgattggccgctatggtcaagctaaccctgtcgatagtatgcgttcactcacctctcaacctgctgcgaaaaaagtcggtggattcgttggttgggttggccttagtgtacccagtgccgtcttggccttttacagcattgtgggtggctggattatctgttttttactgggagccatgaccgatctgtttggtttcaccgcggcaagtgcgtggctgaaaggattcagtgtcgaacgtaatctttttggtacgctgattttttatgtgttaacgatcttgattgtgcagggtggcgtgaagcaggggattgagcgctggtcaacccgactcatgcctgctctatttgtgctgtttgccgtgctgtttatctacatcatgactcagcaaggggcttgggaaggattgaagcattatctgatccctgattttgaaaaagtgtgggatcgtaaattgatcttggcggcaatgggacagggattcttctcattaaccattgggggttgttcgatgctgatttacggctcttatctgagtaagaaagagaacttgccgaaaatggcgatgagcgtgaccttggtggatacagcggtggcttttattgctggtttggtggtgttgccagcaatgtttgtggcaatgaataaaggcgtgcagatttatgcgcaagatggctctttgctgagctctgataccttagtctttaccgtattacctttgatgtttgatagcttgggcttactgggacagattttcgccatggtgtttttccttctgctcaccatcgctgcgctcacttcttctatctctatgcttgaatgtccggttgcactggtgggtgagcgtttcaatactcgccgtacgccaaccagctgggtgttgggcggtttgattgccctgttcagtgtggtgattgtctataactttggtgccctgtttggtttggttgccactctagcgacgcaatatttgcagcctactgccgccttaatgttctgtctctttggtggttgggtatggcagcgtgatgccaaaatgaaagagctgcaagccggatttccggaactgcaacaaagcttatttggcaaaatctggccttggtatgtgaaatttgtctgcccggttttagtggcgacagtgatttgggcttcgtttggctaaataaagcgcggctggcgtaagaaaaagccctcatgatgagggctttttctattgagcagatgcggtatttagagagtgacaagatgtcctgtggttaagggctccaaatcggcttccgttaactcttcgataaactcttcgaccacttgttcgataaggtcatcagctttatgaaaataggcgagatggaacaccgcatccccttcattgactaaggggagcgtttgttgcccaatcacgatgccgctcttgttggctcgaatctccacttctagcttgccaagtggggagttgatgtaagctaacacctggcctttttcgaccttatctcctaaagacaccaatgtacgtaaaataccgtcggcttcggcacgtagccaactggttgattttgcaatgatcgagttaggtatctttttacggctagggcgcagcatgccgatggactgcatcactcgcttgataccgatgatcccagcattgatcgcaatcggatcaaaacgcagagcttcccccgcttcataagttaagacggggatctgctgcttttccgcttcactacgcagtgagccatcgcgtaaaggtgaatcaatgatcactggagtagcaaaggcttgtgcaatgcgcagggtttcgctgttgctcagatcggcacgaatttgcggtaggttggttcggtgaatcgctccggtatgcagatcgaggatgtaatcacaacgctcggcgacttgggaaaaaaaggtgtgcgccatacgtgaggctagagagcctttttcactgccgggaaagcagcgatttaaatcacgacgatcgggtaagtagcgtgatttgtgaataaaaccgaaaacattgacgataggcaccgcaatcactgtgcctttgagttttttttcatcaagtgtattgagcagttggcggatgatttctacgccattgagttcatcaccatgaatggcggcattgatcatcaaaacggggccgggagatgcgccatggagaacttcgatggggatagaaagaggggagtcggtatacagtttggcggcttcgagttcgataactcgccgagaagaggggggaatggtttcccccaaaaatgaaaagtcgccgtgctttttagcctttgccacgagttttagtccttttactggctgcatttttctctatgaattcgacgatcatacccgcaatgtctttccccgtcgcggcttcaatgccttctaaacccggtgaggagttcacttccatcaccagtgggccgcgggcagaacgcagcagatctacacccgctacattcaatcccataattttggccgcttcaatcgccgttttacgctcttgaggggtgattttgaccaatgatgccgtaccaccacgatgcaggttcgagcgaaactcaccatctgcgccttggcgcttcatcgctgcaatcactttatcaccaatcacaaagcagcgaatatccgcaccgcctgcttctttgatgtactcttgcaccatgatattggctttgagtcccatgaacgcttcaataacactttccgccgcagtacgggtttctgccaataccacgccgatgccttgtgtgccttctaatagcttaatcactactggcgcgccgccgaccatatcgagcaagtctttgacatcatcaggcttactcgcaaaaccggtgatgggcatgccaatgccgcgacgagagagcaactgcatggagcgcagcttgtcacgagagcgagtaatcgcaacggattcattggctgggtaaacgcccatcatttcaaactggcgcagtacagcggtaccgtagaaagtgacagaagcaccgatacgaggaatcacagcatcaaaaccggctagctcttcgcctttgtaatgaatctctggtttgtcagagttgatattcatgtagcagcgcaaggcatcaatcactcgaacttcatggccacgctgtttgcacgcttctatcaaacgcttggtcgaatacagcgaagcgttacgcgacagaataccaattttcatttactcggctcctcgaaagggattaaaaacgattttgtaggatcgaccatgattcgatggtgcatggcggtacgtcctaacaacatacgaaaagccatattttctcgattggtcaaggtgatctcaattggccaaatttggccaccaaagctaagttccgatcgaatgacgtagcgcttttcttcgtggccaccggaatcgcgaaccacacgttcgtcaatcacttcggcttcacacacattcactagctgatcattcttttgcatcgggtggatccaaaaacgaacccattgagctccttccttagtgaagctctccactttgaacgcgtgcaagcaagacgttcgggctccggtatcgattttcgctttaatacgttcaatacctaaccctggaaggctgagttcctcacgccatccgacaatcattttttctttcatcgcaatttcattagtttgagaatttcagataccgctaaggacaagcagcaccctcgaaacaactcgcatttggccagttgtcgcttgaagagagtttggtgaataactctgggaacttcaagggggcgaactctagcagccaacctcaaactcaagctaatgaattaaatttgccttttcgacaaaaaaaattgatataaaaaagccgagttatgcactcggcttcttagcggttaggctttcactgggatattggcgagtagtgccaccatctgttgccagaacagatcaaccgtgtctatcttcactttttcatccggtgaatgtgggaacttgatggttggaccgaaagagaccatatccatgtttggatagggttttttgaacagcccacactcaagacccgcgtggatcaccatgatattcggtttgtggccataaatgccttcatacatatcacggaaaatatgcatgatttcagaatcagcatcgggtttccagccagggtaagcaccagaaaggtccagctctgcccccgcaagttgtgccagcgattgcaacatgccctcgacttggtggcggcctgagtccattagggagcgaatcaagcacagcactttgattttgttggcttctgtggtgatcactcccacgttgagtgaggtttctacaacacctgcaatatcatcgctcatgcggatcacaccgtttggacacgtgttcagagcggcaacaaaacgttgttgagtgtgcgcggtcagcacttcactttgcagttctttggcttcaaggaaagttaccaagtgagtttcaaccttacccagttcagctttgagtagctcagtgtagcggtggaataaggtttctaattcggctacgtgctgttctggcaaggcgacggtgacaaaagcttcacgcgggatcgcattacgtagactaccgccacggaattcgactaagcgcagatctaattctttcgcatggcctgcgagaaagcgcgccatcagcttgttagcgttaccacggccagtgtgaatatcacaacctgagtgaccgcctttcaaaccctttaagatcagttggcggccaacataaccagcagggatcgcttcacgctcaatggagaaagtgaactcggcgttcacgcctcccgcgcagcccatatagacttcaccttcttgctcagagtcggtattgagcagaatgtcgccctccagccaaccttctttgaggccaaaagcgccggtcatgcctgcttcttcatcaatagtcagcagaacttcaattggaccatgttggatctctttagaagccagtactgctaggcaagaagccatgccgataccattatccgcgccaagcgtagtgcctttagcagtaacccattcaccatcaatataaggctggatcggatctttggtgaaatcatgcactgtgtcttcatttttttgcggcaccatatcaatgtgcgcttgaagtaccacacctttacgattttccatgcccggtgtcgctggctttttaataaagacgttaccggtctcatcacgacgaacggccaatccttgttctttagcccagttgataatgtattgagctaatgcctcttcatgttttgaagggtgcgggatggaacagatagtggcgaaaaatggccaaattggatttgacgataacttactgatttcggtttggaactcagacacagatgactccttactgtaatttttcccgtgtatcctctctccagagctgggtcgtggcagagaatttgcctgtaacaggtaggtactttcgttgcacagcatatcactgtgcaggggcagggtgtaggtcaaaagtggcaggaaaacgggttttgatcatcggctagcgtcaggaatgataagaagacgtaacgtgactgaggtaggcaaatgcatcttcatgcactttaactgtaatttttcttaataaagttgtaattaaattactaaaaaaatgctgaccaagatcaatttaaatgatttttgtgattttaatcaccttaagtgttgtaatttaatttcttggtggtatatttgtgtacagcttcgctagcgaagagaaaacgctcaaaggatgagtccgatttatcgcctccatggaaccgagaaatcaagtaaacagttttgattttaatggtgatagttatgaataaaggtttatcgtctgcaatgttctggaaccaacactctgtgtacaccggtaactttgcataccctcgtagcttcggctactgatacgcaacttttgcgtctcgaacaagttttgttcacccctaaattggaatttattgacgaccaaatttggtcgatatgattcaccgccatctcacttgaggtggcgtttttttatcctcaaaaaatcttccctattcgaacttgatcgcaacattctgttggtattgagcaattgacttatcttctgatcgacagattccctttttggttagaaaacccgcgtacagtcagaattgtgtctggaatttgttttttgataactctataatcgccgccaatcgtttacgcaaccgtttacttttttaccactaaaggattcgaacatgctggaaaagctttttaaactcagtgaatacggcacgaacgtgcgcactgagatcctcgctggggtcacgactttcctgaccatggcttacattatttttgttaacccagccattttgtcggatgcgggaatggatcgcggtgcggttttcgtggcgacctgtttggcggccgcgattggctgtttcattatgggttttattgccaattatcctatcgctcaagcgccaggtatggggcttaatgccttcttcacttatggtgtggttcttggtatgggacacacttggcaagtcgctctggccgcggtgttctgctcgggcgtgctgtttatcctactcagcttgttcaaaatccgtgagtggatcatcaactcgattcctcactctttacgtactggcatttcagcgggtattggtctgttcttagctttcatcgcattaaaaaatgcgggcattgtggtcgataatccggcaacactggtttctttaggcgcaattacctcgctgcatgcggtgttggcagcagtgggcttcttcctgacgattggtttagtctatcgcggtgtcaaaggcgcggtgatgattgctattttagcggtgacagctctcggtctcgtatttggtgatgtgcaatggggcggcattatgtctacgcctccgagtatcgcgccgaccttcatgcaactcgatttctctgctgtctttgagatcggcatgatttctgtggtgtttgcgttcttgtttgttgacctatttgacactgctggcaccttggttggcgttgcaaccaaagcgggattgatcgaaaaagatggcaaaattccgcgcctgaatcgtgccctgttggcggattcgacagcaacgtctgtcggcgctctgctcggtacttcaaacaccacttcttatattgaaagtgtctccggtgttgctgttggtggccgtactggtttaactgctgtggtggttggcattttgttccttcttgcattattcttctcgccactagcgggtatgatcccagcttatgcgacggccggtgcacttttctatgttgctattctgatgatgtcggggttagtgagcattgattggcgtgatctgactgaagcggcacccactgttgttacctgtttgatgatgcctctgacattctcgattgcggaaggtatctcactcggttttattgcttatgccgcaatcaaacttttcagtggtaaaggacgcagcgtctctctcagtgtatgggttatggcggccatttttgtcatcaaatacattttggcggcgtaagagaagacattataaaaattcaatttaggtttatcacatgagcaaaaaattcgttatcacctgggacaatatgcagcattactgccgtgaacttgcacagcgtcaaatgcctgcagaacaatggaaaggtatcttgggtgtcagccgtggtggcttagttcccgctgctattctcgctcgcgagttgggcattcgctatgtggatacggtgtgtatctcgagctatgaccatgatcaccagcgtgatatgacagttctgaaagcaccagagcatgacggcgaaggtttcttgatcattgacgatctggtggatagcggcgataccgcacgtaaaatccgtgaaatgtatccgaaagcgaaatttgtgactgtctgtgctaaacctgcgggtaaagacttggttgacgagtacgtggttgatattccacaagacacttggatcgagcaaccatgggacatggtgctgtcttatgttgagccagttaatcgcaagcaaaaatagtctttttgccgagaatttgaaaatgaccctttcaagggtcatttttttttactactgttagcccaacttagcgcaacgccagtaaagagacttgtcatgtcagaagcgagcagcaaaaacctgtctgagaccctgtttcaaaatcacaaacaagctaaagagacatcttcgcttacccaatatatgccaagcagtttagagctgttagacactcgccgagaacaatcatcccaagcttggtaccgtaatttgcgccgtttacagtggatttggcagggcgttgatccggttgagcaggaagagatcctggcgcggattgcctcttctaagcattcgcgcactcacgatgagtggcttgatactgtgatgggatatcgcagtggtaactggacctacgaatggacgcgcgttggcatgctgcatcaaaagcaagcggcggagcgtcaaggagaagaggcggccgatcaaatgtttgccgcggcgctctattacagcatcgcgggttatcctcatcttcgaaacgacaacttggctttacaagcccaagtgctcgcaaacaatgcttatcaagaagcggcaaaactgacgggatttgtggttaagcgcttagagttttcctatcaaaacaaaaaaattgctggttatttgcatctacgtaataccgattctccaaagcctgtggtgctggttagtgcggggttagatagcttacaaactgatatgtggcgtctatttcgcgactatttagccaagcgagatatcgccatgctgaccattgatatgccgtcactgggcgcaagctctcactggccattgactgaagattcctcctgcttgcatcaagcggtactgaaccagctggcagatctgccttgggtggatcatttccgtatcgggctgattggttttcgttttggtgggaatgcgatggcgcggctggcttttctcgagtcggataaggtgaaagcttgtgtttcacttggcgcgccaattcacgatattttcacctcccctaataagttggccgccatgccaaaaatgtatcttgatgtactggcgtcacgtttaggcaaaaacgtagtcgatgtgcgcagcttatccggacaattgatggcatggtcgctaaaagtgcagggttttatgtctggccgcagaaccaaaacgccgattttagcactgggattggaaggggatccggtatcgccttattcagacaaccaactcgtggcactctttagccaaggtgggcaagcgaagaaagtaaaaagtaaaacaatttcacagggatatgagcaatccctcgatttggcaataaactggctagaagatgaactttgcaagtgacatttccataaaagtcatcaaaagtaagcaataagtggcgaatatttgttcgtctaattctaaaatctccccgccgaagttgtcggttgagggagataacatggctctcaattgctgcttatggagatgaattatgtcagagatgaccaaaacccctacccactaccgcctgctctctaccttgaaagcgatggggccttatttacgcgaagggcagtgtagtgagcgattctacttatttgattgtctcgcctcatgtgtgaacgataaaaaatcccctgaaaaacgcgagttttggggctggtggatggagttgacgcaaaatgagcaagaaatgtcagcttgctaccatatcggtcgctatacgcttgcgggagattgggttgcagaagcgataccagaatctgcccaagcggaggttaatcatactcaagcggaatttcacaaaaagttagtcaaaacgttacgtgaacgtttcgaaatctctgtcactgtctcaaccgagtccgcgccatttgcctaattaaccctgttcaatcgataacccgaagaaaaaggtgcttttgcacctttttctgcttgtgcattgcagtgtggattgctaaaacatcgtctcttaaagtttttctcaacagaagcaatcatgaccacaaatcaacgaagcatcaaagctccacaaacggttgttgtgaagctgggaaccagtgttctgaccggcggtactcttgcgctggatcgtgctcatatggttgagctcgctcgccagtgtgctgaactcaaaaagcaaggtcactcagtagtgatcgtgacctcgggcgccattgcggctggccgtgagcatttaggttaccctgcgctgcccaacgcgatttccagcaagcaactgctggcagcggttgggcaaagtcgtttgattcaggtctgggaatcgttatttgcgatttatggcatcaaaattggtcagatgctgctcacccgtgctgatcttgatgaccgtgagcgtttccttaatgcgcgtgacaccatcaatgcgttagttgaaaatggcattgtgcctgtggtcaacgaaaacgatgcggtagcaaccaatgaaatcaaagtcggtgacaacgataacttatcggcgctggtcggtattttgtgtggtgcggataagctgctgctgttgaccgatcaaaaaggcttgttcaccgccgatccgcgtaaagatcccaatgcccaactgatcaaagaagtgaccaccattgatgacacactgcgcaaaattgctggtggcagtggcactacactcggtacgggcggcatggccaccaagctgcaagcggcggacattgctcgtcgtgctggtattgaagtcatcattgcggcaggtcgtgcgcccaatgtgatttttgactccttaagtgatgagccacaaggcacgcgcttcttagctttggaagaagcgttagaaaaccgcaaacgctggattttggcaggcccagcggcatcaggcgatattgtgattgacgatggcgcagtgaaagcggtgcaaaccaagggcagcagcttgctcgccaaaggtgtggtgcgagtgcaaggtcagttcgcccgtggtgaagtggtgcgggtactggataagcaaagtcatctgattgcgcgcggcatcgcggcctactccaatgacgagttggcgcaaattgctggtaagcacagtaaagagatcatcgatattttaggctacgatcacggctcagaagtgatccaccgcgacgacatggtcgtgattcaagagtaaaggagagaatgatggatttaaccgtactcggtaaagcggccaaagcggcctctttccaactggctaccgccagtaccgcgcaaaaaaatcaggctctcgccagtatggccgatcagttggaagcgcaaagcgcgagcattcttgctgcaaacgcaaaagatattgcgctggggcgcgaagcgggtttgtctgatgccatgctggatcgcttgctgctcaatgagtctcgcttgcaagcaatcgccaacgatgtgcgtaacgtgatcaaattgaacgatcccgtcggcagcgaaattgatagccgagtgttggaaaacggcatgtcattggcacgccgtcgcgtcccccttggtgtggtcggcgtcatttatgaagctcgccctaacgtcaccattgatattgcggcgctgtgtttaaaaaccggtaacgccgcgattttgcgcggtggcaaagagacgtttttctctaacatggaactggtcaaagtgatccagtcggcgttggataaagcaggtctgccagcggcttccgtgcagtacattgaaaagccagatcgtgaactggtgacgcaactcctgaaaatggatgattacgtcgacatgatcatcccacgtggcggtgcgggcctgcacaaaatgtgcaaagaaaacagcactgtgccagtgatcattggcggctttggcattagccatattttcgtggatgaaagtgccgatctggataaatccgttgccgtgattgaaaacgctaaagtgcagcgcccatcggcgtgtaatgcgctagataccttgttagtccatcaagcgattgccaaaccgttactagacaaactcatcgcaaaactgaatggcaaagtggcgtttgtggcggagccaaaagccaaggcgttgatgagttcagcggctgagctgcgtgatgcgcaagcgggcgattttgataccgaatggctcagctacaccttaggggtgaaagtggtacaggatgtgcaagaagccattgagcatatgcgcgagcacaatgcgagccattccgatgcgatcatgaccaacgatctctataacgctgagctgtttgtgaatacggctggttcagcggcggtgtatgttaacgcttctacgcgttttacggacggtgcacagtttggtttaggcgcagaagtagcagtctcaacacaaaaactgcacgcgcgtggcccgatggggctagaagagctcaccagctacaagtgggtgggtaaggccaattacctgtcacgcagctaaaattcaagcaaagatgtgatgtaaaggggcttcgcgcccctttttctttggctctcaacagcacatcggctacactggttgccttgttatggaggtaatatgcattgtcctttctgttctgaaaacgataccaaagtgatcgattcacgtctggtggctgacggacatcaagtgcgccgtcgtcgtcagtgtctggcttgtaatgagcgctttaccacctttgaaaccgcggagttagtgatgccgcgcgtgatcaaatcgaatggtaatcgtgagccttttgatgaagagaaaatgattggtggcttgcagcgcgcattggaaaagcgcccagtgagtgcagatgcgattgaactggcgatcagcaccataaaatctaagctacgtgccactggcgagcgtgaagttccgagtaaactgattggtaacttggtgatggaacagctgaaagtgctagataaagtggcctatattcgctttgcatccgtatatcgtagttttgaagatgtccgtgaatttggcgaggagatcgccaaactgcaggactaaccgataggattaactgaaagcgattatgcctatgtttacctcttttgatcatcaaatgatgtctcgcgcgattgaacttgcgtggcgcgggcgttttaccacttctcctaatcctaatgtcggctgcgtgatcactcgcggtgagcagattgtaggggaaggtttccattttcgcgcgggcgaaccccatgctgaagtgcatgctatgcgccaagccggtgagcttactcgcggtgcgaccgcttatgtcactttagagccttgctctcattatggtcgcacaccgccttgtgctgaagggcttattaaagccggggttgcgaaagtgatttgcgcaatgcaagaccctaacccacaagtggcggggaagggcgtacaaatgctgcgtgatgccgggattgaggttgaagtggggttgctggaagcggatgctcgagtactcaaccgcggttttctaaaacgtatggaaaccggcatgccttttgtgcagcttaaaatggcggcgagtctcgatggacaaaccgcgctcgctaacggtaaaagccagtggattacctctcctgcagcacgtaaagatgttcagcggtttcgcgcgcaagccagtgcgattctctccaccagtcaaacggtgctggcggataatgcttctctggcggtgcgttggtacgatttaccgtcatcggtacaggcgcaatacgcagaagcggatttgcgtcagccactgcgggtgattttggatcgtcaacatcaattgcatccagagttagcgttataccaaacaccttcacccgtgctgcgagttgccagcgagaatgccgaactctgtatctctgctgagaacggaaagcttgatttgcgtgagcttttggcactactcgctcagcaacacaatgtgaatcaactctgggtagaggcggggagccaactggctcaatctttgattgagcaaaagttggtggatgaaatcattctctatttagcgccgaaactgatgggcagtgatggccgtggtttatttggcgcgctcggtttgacggaaatggctgaggccattgaactcaaaatagaagattgtcgaatggtgggggcagatttgcggatcatcgccaccccaaaaacaaaagattagcattatgtttacaggtattgttgaagcggttggcaagctgaccgctattatccctaaaggcagcgacgtcaccatcagtgtagatgtgggtaagctggacatgggcgatgttaaactcggtgacagtattgccactaatggcgtctgcttaacggttgtggcatttgatcagcgtagttttagcgcggatctgtcgatggaaaccctcaaaaaatcgggctttgcacagtatcaggttggtgatcgcgttaaccttgaaaaagccatgctgcccacgacccgttttggtggtcatatcgtctcagggcatgtggatggcgtaggtgaaatcgtcgagcgtattcctgtggggcgtgcggtggatctgtgggtcaatatgccggcagaaatcagcaaatacgtggctgaaaaaggctcgattaccgttgatggcatcagtttaacggtcaatgatctgcgtaaaaacgcgtttaaactgaccatagtgccccacaccagcgcagaaaccactatcgatgaattccaagtgggacgccgagtcaatctggaagtggatgtattagcacgttacatggagcgtttactgcaaggtcaacaagagagtgaacctcaatcgcgtctgaccatggcatttttgcaacaaaacggttttgcttaacctcagctctcagaggtttcataacaataggactgacatcatgccaattagcaccccacaagagatcattgaagacattcgtcaaggcaaaatggtcatcctgatggatgatgaagatcgtgaaaatgaaggcgatctgatcatggcggctgagcacattacgccagcagcgatcaattttatggcaacccatggtcgcggactcatctgtttaacgctcacgaaagagcgttgtcgccgtctgggtttaaatcccatggtacaagataataatgcccagtacaccaccaatttcaccgtttcgattgaagctgccgaaggcgtgaccaccggtatttcagcggcggatcgcgcgcgcacagtacaagcggcagtggcaaaagaagcgaaagcggccgatttggttcagccggggcatattttcccgttggctgcacaagatggcggagtattaacgcgcgctgggcacacagaagctgggtgtgatttggcacgcttggcaggtttagagcccgcgtcggtgattgtggaaattcttaatgatgacggcaccatggcgcgtcgtccggacttagaagtgttcgctgaaaaacacggcttaaagctgggtacgattgcagacttgattgagtaccgcaaccacaccgaaaccaccattgagcgtgtcgcgcagtgtaaactgccaaccgaatatggtgagtttgagctggtgacttaccgcgacatcatcgataagcaaatccactttgctctgcgtaaaggcgatattactagtgcgccaactcttgtgcgtgtgcatctgcaagatacttttaccgatctgctgcacagcaaccgtgcggcagagcgcagttggccacttgcgacagcaatgcagcgtattgggcaagaaggcggggtgttggtgatcctgggtcatgaagaatcgagtgagctcttgctacaccgagtgaaaatgtttgagctgcaagataaaggcgaagcccctgcgatggccaaaaaacaaggcacttcacgccgggtcggggttggctcgcaaatccttgctgatcttggagtgaaagagatgcgtctgctctcttcaccaaacaaaaagtaccacgcattgggtggttttggtctcaatgtggtcgaatacgtctgcgaataatcgctattcccttgctacttgaagtggcagtggagtgagcgaccttcattcccccaagcatagaacctacctatactgggggatgaacttactgtccgcctcgctgcaaaaacaagtcgtttgaggatatttcatggctggtttaccgcgttttagcttgatggcagtgcgcggtgtaagcccaaatttctgttagatattgctcacaaatttgtgctagaatccggcgattctcacttgatgaacagagttaaaggaaagcttatgaaagtgatcgagggtggtttcccagcaccaaatgcgaaaattgcgattgtgatttctcgtttcaacagttttatcaatgaaagtttgctgtctggtgccatcgatactcttaagcgtcacggtcagatcagtgatgacaacattaccgttgtgcgttgtcccggtgcggttgagctgcctctggtagcgcaacgtgttgcaaaaaccggcgactacgatgcgattgtctctctgggttgtgtgatccgtggcggtacaccgcactttgactacgtttgcagtgaaatgaataaaggtctggcacaagtgtctctggaatttagcattccagtcgcattcggtgtgttgactgttgatactatcgatcaagctattgaacgcgcaggaaccaaggctggtaataagggtgctgaagcagcactgagcgcacttgagatgattaatgttctttctgaaatcgattcctaatgggggccagtgtgaaaccagccgcacgtcgtaatgcacgtcaatttgcgctacaagcaatttattcatggcaaattactaaagagaatgttgcgactattgaagagcaatttctaaccagcggtaagtacgatgaagaagaacatcgtgccgctgagccagctcttgctgctcctgaaaccgatgtttcttatttccgtgatctgctggcgggtgtggttttaaaccataatgaactcgacagcaaactgcgtccttttgtttctcgtccgatgcaagatctggacatgatggaactggcgctactgcgtttggccatgtatgaaatgacgcgtcgtgaagacgtaccatacaaagtggtgattaacgaggcgattgaactggcaaaagtgtttgctgcggaagatagccataaattcgttaacggtgtgctggataaagccgcaccgcacgtacgtaagaaagcgtaatccgttttccaccagaaggtcagcagtcgctgaccttttttcttgataagctgcgacctaatgcagcgtttcaaccaaagagtctggatgatgtttggtgaatttaatttaatcgataaatacttttccaaccgacaagcacaacgcaaagacgttcacttagcattgggtgatgactgtgccattgtcaaagttcctgaaaattcgcgcgtggcgatcagcacggataccttagttgctggaacccattttctggctcaggccaatccggcttgggtcgcgcacaaagccttagcgtcgaacatcagtgatttggcggcgatgggcgcgactccggcttgggtttcgcttgcgttgactctgcctgagattgatgatgcgtggctaacgccattttgcgatgcttttttcgagttggccaagtactacaatgtgcagctcattggtggcgataccaccaaagggccactcagtatcacattaaccgtgcagggctttttacccaaagagcaggctatgctgcgtagcggggcgaaagttggcgattggctctatgtcacgggcgatctaggcgatagccaagccggcttagacgtgattttagatccggaaaagcgccatttacccttcgccgatattcttgagcagcgccattacttgtcgacaccacgcattgtggcagggcaagccttagtgcatttggcctcttcggcgattgatatttccgacggcctgattgccgatctgcaacacattttgcggcgttccaatgttggggcgagtattgatgtcagcttgttgcctctgtctaaagagttattgcagtttgtagacagtgtcactagtgcacagcagtatgccttgaccagcggtgaagagtacgaactctgcttcaccattccagaagaaaatcgaggctcgctagaaaatgcgctcgcacattgcggcacgaaagtgacctgtattggccaaattcgcccggccggtacgtttgagctgcacaatcaggggaaaaagctcgattggcaactggctgggtatgatcatttcaaggtgaaagcatgagcgatccacgcagtaatctctccttaagtaacccttggcacttgcttgctactggttttggcagtggcttgtcgcccatcgtgcccggaacgatgggcacgttagcatcggtgccattttatctaatgctggcacagctcccttggattctgtatgccgtcgtggttgtgttcgctagcctcatcggcataaaaatttgccaagtcacctcagatgatatgcaggtacacgatcacggttcgattgtttgggatgaatttgccggcttttggatcactatgctgattgtgccgttataccaattaccggttttcgattggaaatggctcgtgacaggttttgtgctatttcgctttttcgatatgctcaaaccttggccgatcagttggttggataagcgtgtgcatggcggtttcggcatcatgattgatgatttagtggctggagtaatggccgcgataagtttagcggccatcggctactggttagagtggctgcctgtttgagattcgcctgtttaggttcccctaggggaacctaactcagctagtttaatttttgcaaatcggcttcaatttcggcaattttactggcaacgaccttttccaaatggcgtaaatcattaagaattttctgtttcacgtctacttcacccatgacttcaggtttggttatcttattaagctcatcaatcaccagcgttaaattgcgattaatttcagtgacttctttgtactgatgactgccactgtcgaccaatacatttttgatctgccttggatacttaaacttgacgcttttggcgaacagctcgcccttttgctttttgaagtagatctttaatacatctttatgcgcttcttggcgcagcgaatagcgttcaatttgcgtaggttcattaatacccaagccaacgagatggggaaacataggcaacctcttagttaaaataacccgcacgcctcttgatatacccttcctacttgaagctgcagcggtgttagctacgttcgttcaccccaatcacatagtttgtctatgctcatggggactcactcacttgccgcctacctgcaactccaaattgtttgggtatatacatttaccaagatggcactcaatttactgtagcagttggttgatgtgcctgacagttcaataggttaacttgtgctcaagatcgcacccgaaccttgaccgtttcgctactgagcgctaggcgcgagctctgcgacatgttcaatcaatttctcgcgcaagtgctgctcctcctcttcattgaggcgcgtgccttgggcgttggtcaaaatgaataagtcttctgcgcgctcacctatggtcgtgattttagccgcatgcaaatccaagttgagttcggcaaaggttgctccgacggtagccagtagtcccggcgtatccagcgcgacgaattccattaaggtgcgctttttactcttggttggtagaaaatcaacctgagttttgactttaaagtgctgcaagttacgaggaatgcgccttgccttttgcgtggtaggacgaccatcttccagtacatgcaccagatgacgaatcagtgcttgatggcgatcttcttcaatggcttgcccattttggtcaagtaccatgaaagtatcgagtacataaccgtctttactggccatgatttgcgcgtcatgcacgttcagattacgtcggtcgagctcggcaaccacagtcgcaaataaagcagcctgatccttggtgtagataaaaacttccgttccgccgcgagtggcttttttgctgagtaaaaccaaaggtttgctactgtcttcatggcgtaataaatgggtgcagtgccacgcgatctgtttatgagtatggcgcaagaaataatcggctttaaagcgctgccacaacacctcaatttcacggctagagaagccttctttgcgcagtaaggcagaggccatttgctggttatgacgaatgcgttcacggacatcgacgggattttctaggccgcgccgtagcgcgcgctgggttgagtaaaagagctctgccaacaaagtccgtttccaactgttccaaagctcagggttggtggcgcagatgtcagcgacggttaaacacaccaagtattcgaggcgctcttcatcacgcacttttttggcaaattcgatgatcacatctggatcgtagatatcacgacgctgcgcggtgactgacatcaggaggtgatttttgaccagccaagcgaccaatttcgcttccggtttagataaaccgtgctcaatacagaaatcaaacgcttcatcagcaccaatttctgaatgatcaccgccgcgtcctttaccgatatcatggaaaatggccgcgaggatgagcagctcttttttctgaattttagggtaaatttcacagcaaatagggtggcggtcgtggttattggcatcactgaatagatggatatgtttgagtagacgaatactatgttcatccaccgtatagacgtggaacaagtcgaactgcatctggccaacaatctggttccattggggcaaataagcagcaagtacgcccagcttgtgcatttggctaaacgctttatgcagtgcgttggggtggcgtaccagctcaataaacttttcgcgtgcggcgggaagggtgtgcagaaatttattcagtcggcgacgagccgtgcgtaattggcgcatggtggctggcgcaaccgattcgatggtggagtcgctggccatgtgcaaaaacatatccagaatagtttctggacgagcttgaaatagcgcgggtttacgcgcttcaatcatattgccacggcgttggaagtcatcatcaataatcacggcttcggcttcttcaccattattgaggatcgctttatcgaaaattttcagcagcattttgttgagttcagccacacgacgcagggtgcggaaaaactctttcatcatcatctctatgccacggttgccttcaccaaagtaaccgagatgacgagcaacttgcacttgatgcgcgaaggttaagcggttgtcgtaacgtttcagctcaatgtgcagcgcaaaacgcacgcgccataaaaagtcttggcactcaaccagctcacggtattcggcatcggtcagaaaaccaaagcggctcatctcatacaaggacgttgctccaaaatggcggcgtgcgacccaacttaaggtgtgaatatcgcgtagcccaccgggagtcgatttgatgtctggctctaagttgtaggtggtgtcgtgatatcgagcgtggcgctctttctgctcacgcactttggcttgatagaagatttcacttggccagaaggactcagaatggatcaccattttcaggcgatgaaaggtctcttcacagccgcacagtaagcgcgcttcttgcaagttagtggctacagtgaggtcggctttaccgatttcagcacactgttccacggttcgtaccgcgtggccaatctccaattttaaatcccataacagggtgagaaattggctgattttattggcgacttgttcgctgagcggctgttgagataagactaggagatcgatgtctgagagagggtgtagctcaccacgcccataacccccaaccgcgactaagctcacttcaaccagctcatcaaagccaaaaaattgccacaaacggtggagtagcaagtccatgtattcggagcggccaagcactaagtcggtcactggatggtgatcgaaaaactcctgcttttggtattcagtaaagctttcgagctgctgctttaagctctctaccgtcagttggggttcttgaaatgtgataggggattgatacggcatagcgcgtccatgcaagcgttaacacgaatggagccaatctagcagatggcgacggataaaaaaatatccctgaccagcagggatattttcaatcgaaggaaaacttaggcgttattcaagatgcgtggcaggctttcttcactacgtagcgtcaggatttcacagccagttgcagtgaccaaaatcgtatgttcccactgggcagattttttgccatcggcggtgtagaccgtccagctatcttcatcatcaagacggcagccaaatttaccggcgttaatcatgggctcaatggtgaaaatcatcccttcacgcagcacggtgcggtcactgtttttgtagtgcaccacttgtggctcttcatggaactcagcaccaatgccgtgaccacagtaatcacgcacgatagagaatttaaagcgcgggttgtttttgttgttggtcttgatgtgtttttcaatcgtggttccaatttcgcccaattgaacgcccggcttgacttgtttcagtgccaagtaaaggcactcttgcgccacatgacacaggcgtttgtcttcaatcgacacatcgccaatcaaaaacatttttgaggtatcgccgtggtagccgtctttgataaccgtaatatcgatattaaggatgtcgccatcacgcagtaccgcaggacgttggatctgaccaaaataagtatcttcactggcaggaatgccgtggcagacaatgtggttgatcgacgtacagatcgattttggaaaaccgtgataattcagtggtgccggaatcgcgccttgaacttcagtaatgtacttatgacatatctgatccagctcttcggtagtcacgcctgctttcacatgaggttcaatcatttccagaacttcagcggctaagcggcccgcaacgcgcattttttcaatttctacggcattcttgatttttatagacatcggctttctctactcacttgtgagcacacaaggtgctagtggcgctattgtaacaatggacagatgaagcgcaagaaaacagtcgtccggcgttaaaatcgagtggctaagtcatggctttgcattggctatcgacgaattttttctagccacacaggggcgaaatatgatataaagcgcgccggaatccgggtccttattctccctgttggcgaaaaggattgggaaccacaaacctaattgtttaaatcacacacattccgacacgtattccggggtgctccaagtggagtcggatatacgggggatgtggaggcctaaccccatagaggattttaaaatggcatctgtatcaatgcgcgatatgctgacagcgggcgtacacttcggtcaccaaactcgttactggaacccaaaaatgaagcaattcattttcggcgcacgtaaccgcgttcacatcatcaacctagaaaaaactgtacctatgttcaacgaagctctagctgagctggcaaaagttggcgagaagaaaggtaaagttctattcgttggtactaagcgcgctgcatctgagtctgtgaaagaagcagctctagcaagcaaccaatactacgttaacaaccgctggttgggcggtatgctgactaactggaaaactgttcgtcagtcaatcaagcgtctgaaagagctggaagttcaatctactgacggtacttttgacaagctgactaagaaagaagctctaatgcgcactcgcgaaatggagaaactggaaaagtctcttggcggtatcaaagatatgggcggcctgcctgacgctctgttcgtaatcgacgcagatcacgagcacatcgctatcaaagaagcgaacaacctaggtattccagtatttgctgttgttgatactaactctagcccagacggcgtagactacatcatcccaggtaacgacgacgcgatccgcgctgttcaactgtacctgaatgctgctgctcaagcgatcaacgaaggtcgtaacaaagacgtagctgctgtagctgaaaaagacggtttcgtagaagcggaataatctcggctctgagtgaaacttaggctatctgccatgattgtgtagcatagcccaagttatagttagcattgggggccgataatgtaggccctcaatttttacccaatccagaattaactgaggaatagagaatggctgttactgctgctctagtaaaagaactgcgcgagcgtactggcgcaggtatgatggaatgtaagaaagcccttgttgaaaccaacggtgacatcgagctggcgatcgagaacatgcgtaagagtggtgctgctaaagctgctaagaaagctggcaacatcgctgctgaaggcaccatcatgatcaaagaaggcgaaggcattgcggctctagttgaagtcaactgccaaactgacttcgtagcaaaagacagcaacttcgtagcatttgctaaccaagttactgacgctgctctcgcttctaaagcctctgtagaagagctgcaagcacaattcgaagaagctcgtgttgctcttgttgcgaaaattggtgagaacatcaacatccgtcgcgttcagtacgttgaaggcgaagctctggcgacttatcgccatggcgaccgtatcggtgttgtcgttgctggttctgctgacgttgaaactctaaaacacgttgcaatgcacgtagcggcttctcgcccagaattcctgactccagacgacgttcctgctgaagtggttgctaaagaacgtgaagttcaagttggcatcgcaatgaacgaaggcaagtcaaaagaaatcgcagagaaaatggttgaaggccgtatgaagaaattcactggcgaagtttctctgactggtcagccattcgtaatggagccaaagaaaactgttggtgaaattctggctgagaaaggcgcaactgtttctgcattcatccgtctagaagtaggtgaaggcatcgagaaacaagaaggcctgagctttgctgaagaagtagcactggcgcaaaaaggttaatcctagcgcgattgctcagaaaaagaccgtggccatggctgcggtcttttcacgattaaggtgttgattcgttaatgattgaatcataaagcgtcgactcgattaaccgtgatgaatggattttggcctagcactcaaatctatccatgactgttaatcctcaactctctttggaaggtaaactcccatgacaacgaaccctaaaccagcttatcaacgtattctgttaaaactaagtggtgaagcgctacaaggctctgaaggttttggtattgatccaacggtacttgatcgtatggctcaagaagtaaaagaactggttgagctgggtgttcaagtgggcgttgtgattggtggcggcaacctattccgtggtgctggccttgccaaagcgggtatgaaccgtgttgttggggatcatatgggcatgcttgccacggtaatgaatggtttggcaatgcgtgatgccctgcatcgtgcttacgtcaatgcacgtctgatgtctgctatcccactaaatggtgtgtgtgacgattacagctggtctgatgcgattcgcgaattgcgccaaggccgagtggtgatttttgctgcgggtacaggcaatcctttctttactacggattcggctgcgtgtctgcgtggtattgaaattgaagctgatgtcgttctcaaagcgaccaaagtagatggtgtttacagcgctgacccggtagccaacccggatgcacaactgtatgataagctggcttacaacgatgtgcttgagaaagaactgaaagtgatggatttggcggcgtttactctggctcgtgaccataaaatgccaattcgtgtcttcaacatgaataagccaggcgcacttcgtcgtgtcgttatgggtgaagctgaaggtacgctgatcagcgacgtgcagtgatccgtctgcgaacgaaacgctctcgaaacgaaaacaagaattaaggtgatattgtgattaatgagatcaaaaaagatgcgcaagagcgtatggagaaaagtgttgaagcactgaaaaatggcctgtcgaaaattcgtactggccgtgctcacccaagtctgctgacgggtatttcagttgactactacggcgctccaactccacttaatcaggttgctaacgtgattgctgaagatgcacgtacgctagcgatcaccgtgtttgatcgcgaattaactcaaaaagttgaaaaagcgatcctgatgtctgatctgggtctaaacccaatgtcagccggcaccattatccgcgttccactgccaccgctcacggaagaacgtcgccgtgatctggttaaaatcgtgcgtggtgaagcagaaggcggtcgtgttgcggtacgtaacattcgtcgtgatgcgaacaacgatctgaaagcgctactgaaagacaaagagatttcagaagacgatgaacgccgtgcacaagaagagattcaaaagctgacggatgcggcagtgaagaagatcgatgatgtgcttgctgcaaaagaaaaagagttgatggaagtttaatccactgacttggtgaacaaaacgctgtgctcgcagcacagcgtttttttatgctactcttgcgcctctttgattgttcgttgtgtttcttatgcaaaatctatctctttcccaagatgtattgcctaaacatattgccgtcattatggatggtaatggtcgttgggcgaaagcgcagggaaaaccgcgtgttttcggccataaaaatggtgtggctgcggtacgaaaaaccatctctacttctgctcgccttggcattaaagccgtaactctgtttgcttttagcagcgagaactggcgtcgtccggaagaagaagtgggcgtgttgatggaactttttatgacggttctttcaaccgaaattaagaaattgcataaaaacaatctgcgtttgcgagtgatcggtgataaaagccgctttagtgagcgtctgcaaacgaaaatcgcgcaagcggagcagttaaccgccagcaataccggcatggtggtcaacatcgctgcgaactacggtggacagtgggatatcttgcaagctactcaagcattggctgaaaaggttacccaaggtgaactgcaaccgtcggacatcgatgaagacgtatttaagcagcatttgactatggctgatctgccggatgtggatttgttgatccgcaccagtggagagtgccgcattagtaattttatgctttggcaacttgcctatgcagaaatgtatttcactccagtcttctggcctgagttcgatgaaaactgcctgattgaagcagtgacttggtttgttaatcgtgagcgccgttttggctgtactggtgaacaagtcaaggcattgatggaaaactgaatataggacttctcaatttgaagcagcgaatcattacagcgcttattctggcgcctttggtgatccttggcatcctttatctgccttttgcttggtttatgttggcactcgcagtagtgaccttactcggattctgggaatggactcagttcgttaaccaaccatcacgcatgttagccatgattcccgccttattggttggtggtatcagtgtcgctttgatcgactttcaatttccggctatcagcaatatgaatacggcgcattttattgtgctgggtatcggtagcctttggtggctcgtctcaagtggactggcgatcacttatccgcgctcgcgtccattatgggagcactccagcactgttcgccacctgtttggcctatttacgctgctgcctttcttttggagtgtgttgttcttacgcgccgatacttacctttccgatcctctttatggtgcgaaattagttctcttcgtctgttttctggtctgggccgcagacagcggtgcctattttgtgggaaaaagcttaggtaaacacaaaatggcgcccgcagtcagcccgaataaaacgatagaaggtttggtcggtggcatcgtcaccgccatgctggttggttattgggtagcagagtgctttggtattcaatttagctctatgcctgtcatgctgctgatcatcttattgactgtggtaatttcggttttaggggatttggtcgagagcatgtttaaacgtgtttctgggatcaaagacagcagcaatatcattcctgggcacggcggcattctggatcggattgatagcctaacggccgctttccctgtgttcgctcttctctatttcttgttctagtactcaggctgcttaggcagcctgatgtgaataacagcgatcttcactatgcgtaaactaaccattttaggtgccacaggttcgataggagccagcacccttaaggtgatagcccaaaatccacagcagttttccattgttgcgttagtggctggggtcaacgtagccaaaatgtaccagctgtgccaacagtggcggccgaaatatgccgttatggcaacggcgtcagcagcatctgagttgcaaggcttgctcaaaaaccaagcgatggcgaccgaagtgctgtacggcgaagaggcgatgtgccaagtcgcggcgctggatgatgtggataccgtgatggcggccattgttggggccgcaggtttgttacccaccatggcggcggtgaaagcgggtaagcgtgtgttacttgccaataaagaagcattggtcatgtcgggacagctatttattgatgctgtcgcacaatctggcgctgaattaatgcccgtagatagtgaacacaacgcgattttccaatgtctgccgactgaaatccaaactcagttggggcgctgtgatttatctcaacacggtatcgaccatattttgctcacgggctctggcggccctttccgctatagcgaccttgcgaccttagatagcgtgactcctgagcaggcgattgctcatccaaactggtcaatgggaccgaaaatttcggtagattccgcgaccatgatgaacaaaggccttgaatacattgaagctaaatggctatttaacacgtcacgtgaacagctcaaagtgctcatccatcctcagtcggtgatccactctatggtgcaataccaagatggttcagtgattgctcagttgggcgagccggatatggcaacgccaatctcctatgccatggcttatcctgagcgagtgaccgcgggagtgccagcactggattttacgcgtttgcagcaactgacctttatggaggtcgattttgcgcgctacccgtgcttgcaattagcgatggatgcgtgtttcctcggccaacatgcgacaacctcgctcaatgcagccaatgaagtagccgttgacgcgtttttaaagcggaaaatacggtttactgacattgcactcatcaatgatcaagtattgtccaaggtctgtgcgaccaacacccagttacattgccgtgacttggaaagcctgcttgagctagatacaatggctcggcattttgcccatcaagtactcaaagagcgccaagcatgaccgacatattgtggaactttatcgccttcatcattgcgctgggcattctcgtcgcagtgcatgagttcggacacttctgggttgccagacgttgcggtgtgaaagttgagaaattttctatcggttttgggaaatcgatttggaaacgcgtcggccatgacggtacagaatactcgatatcgatgatcccactcggtggttacgtcaaaatgctcgatggacgtgtggatgatgttcccgccgaacagcaagccatggcgtttgataagcagtcactctggaaacgttctgccattgtgagtgcgggccccatttttaacttcctcttcgcaatctttgcctattggctggtgtttatgatcggcgtaccagcggtcaagcctgtgattggcgaagtgacaccctactcgattgcggctcaagcgggccttgagccgggtatggagatcaaagcggtttctggcgtgaatactcccgactgggaatcggtcaacatgggcttaattggtcatattggcgatgacagtatgacgatcaccgtctcctccgccgaaggggtgggattgaatgaaattaagacaataaatctgcgtgattggaactttgacccagaaacagagtctgctatgggggcgcttggctttaaaccttttacccctgagatttccaatcagctgaccaatgtttctgcgcaaggtgcgggtgagcgtgcgggtttacaagtcggtgataccgtgttgcaaatcaatggacaagcggttgaggcttggcaacaagtggtcaatgcaattcaaagtcatcctaacgcgcctatcgcagttatggttgagcgagcaggccagcaagttgaactcactttgattcccgatagccgtgagctttcgcaaggaaaagtgattggttttgcgggaatcgcaccaaaagtcgcagaatggccgcaaaactatcgatttgaattgcaatttggtgtatttgagtcgcttggtaaagcggttgaaaaaagcggacaagtgattgacctgacggtcagcatgttgaaaaaactgttggtgggcgatgttgggttgaataatctcagtggtcccatttcgattgctaaaggcgcaggaacaacggctgactacggctttgtgtactttttaggctttttggctctgatcagtattaaccttggcattatcaacttggtgccactgccgatgctggatggtggtcatctgttgtttttcatgattgaagcggtgatccgtcgccctgttccggaaaaggtgcaggaaatgggttaccggattggtggtgccatcattttctctttaatggccgttgcaatctttaacgattttactcgcctgtgattgataaacattaggcaagagttgcagtaaggaagaactcaaaacaatatggcgatgaaacagattctgctcgcgacactgcttgccacgagcgtgtcggcgaatggtgccgaaaaatttgtggtacaggatattcaaattgatggcctgcaaagggtcgctttgggtgcggcgttgttgaaaatgcctgttcgagtcggcgacagtgtcgattcgcaagatgtcgcgaacatcatcaaagcgctctattcctcaggtaactttgaggatgtcaaagtattgcgtgatggcaataccttgatggtgcaggttaaagagcgcccgaccattgcaagcgtgtcgttttctggcaacaaagcgatcaaagaggagcaactcaagcaaaacttggaagcttcgagcatccgagttggcgaagccttggatcgaacgacactcagcaatattgaaaaaggcttagaagatttttactacagcgtgggtaaatacaacgcgaccgtgaaagcggtggtaaccccattgccgcgcaaccgtgctgaccttaagtttgtctttactgagggcgtttccgctaagatccaacagatcaactttatcggtaaccaagtgtttagcgatgaagagttgctgtcacgttttaacctcaacgttgatgtcgcatggtggaacttccttgcggatgataagtacaagaagcaagtgctggcgggtgatattgaagcgctgcgtacttactatctggatcgcggttatctgaagtttcaggttgatagcacacaagtggccatctctcccgataagaagggcgtgtacatcacgctgaacttgaatgaaggtgagccgtacacggtaagcaaagtgcagttccgtggtgagctgatgggcaaagaggccgagtttacttctcttatcccatttgaaatcggcgaaacctataacggttctgcggtgactagactcgaagagagtgttaagaaagtgcttggggaatctggctacgcctatccacaagtacgcaccattcctgaatttgatgatgaaaagcagcaagtgtcactggtggttcatgtcgaagcgggtaaacgtgtctatgtccgtgacatccgttttgtcggtaacaacagcactcgtgatgaagtcttgcgccgtgaaatgcgtcagatggaaggctcctggctcaactcaaaagacatcgaaaccggtaagactcgtctcaatcgtttaggtttctttgaaacggtagaagtgcaaacggtgcgcgtgcctggtagtgaagaccaagtggatcttgtttacagcgtaaaagaggcgaactcaggcaacgtcaacttcggtgtcggttacggtactgaatccggggtgagcttccaagtcggtctgcaacaagacaacttcttaggttcgggtaaccgcgttggcgtgaatgccatgatcaacgattatcagaaaaacctgacgttagaatatcgcgatccttactggaacctcgatggtgtcagcttgggcggcaaagttttctacaaccagtttgaagcttctgaagcgggcattgttgactataccaacgaaagttacggaaccagtttgacttggggtttcccatttgatgaattgaaccgatttgagtttggtattggttacacccacaacaagattggtaacttaacgccttatctgcaagtggaaaacttccttgctgcgcaggcgagtaacatcgattctggcggtaacttgttgaccgatgacttcgatatcaacttatcttggacgcgtaataacctcaataacagctattttccgacggcgggtaaccaccagcgtgctttctacaaaatgacagtgccggggtcggacgcgcagtactttaagctgcaatacgatgttcgtcagtatttcccgttgaccaagaaacatgagtttaccttactgctgcgtggccgtttaggttacggtaacggttatggtcaaacggatggaaaagataacttgttcccgttttatgagaacttctatgcgggcggctttacctcattacgtggttttgggtcaaactctgcaggtcctaaagcggtgtaccgtgactactcgggttcgaacaatggctccgatactgccaccgatgattcggtagggggtaacgcgattgctcttgccagcgtagagctgattgtaccaacgccgtttgcttcagaagaagcacgcaaccaaattcgtaccagtatcttctacgatatggcgagcgtgtgggataccgagttcgattatcgtggtaaagcggattatggtaaccagtactattacgattattcagatccaaccaattaccgctcatcttacggtgtggcgttgcagtgggtgtcaccaatgggacctttagtgttctcattggctaaaccgattaaaaagtatgagggtgatgacgaagaattcttcaccttcaccattggaagaaccttctaggagaggaacatattttgaaaaacatgatcaaagcagccagccttggcctgattattcttagctcatcaatgatggcgaatgcggctgaagcagcgcagaaaattggctacatcaacactgcgcaagtgttccaagcgctgccgcaacgtgaagtcgtttggcaaaagatgcaagaagagttcaaagacaaagcggctgagctgcaagctatccaagcggatgctaaaaccaagattgagaagctcaagcgtgatggtcaattgatgggacaagatgaagtagagaaactgcgcatcgaaatcggtcaattggacagcaaatacaagatcaaagcacaagcgttagagcaagcgtctgctcgtcgtgaagccgaagagaagcaaaaactgtttaaagtgatccaagatgcagtgaagaaagtggctgagaaagaaggctacgatatcgtgctagacacgagctcaatgcaatacggtaagccagaacacaatctgtctgagaaagttattaaagccattaaataatcgaaaattatgaccacactcactttagccgaattggctactatcaccgggggggagttgttcggtgatccaacagcactggtcagtgccgttgcgcctatggataaggcacagcttggacatgtgacattcttgtctaatcctaaatacagtaagcacttaggtgattgtaaagccacggtgatcatggtgaaaaccagtgagcgagaactctgtccgagtaacgctctggtggttgccgatccgtatgttgcatttgctaaagtggctcaggcgctggattcaactccttctcctgcacacggtattgcaccgagtgctgtgattgctgaagatgcaaagttaggtcacaacgtttcgattggggcaaatgcggtcattgagtcaggtgttcagcttggcgataacgtagtgattggtgctggctgttttatcggtaaacaagcgcgtttgggcgataacactaagctttgggccaatgtaacgatttaccacaaagtggaaatcggctcagattgtttgattcaatctggaaccgtgattggtgctgatggctttggctatgcgaatgagcgtggcgagtggattaaaattcctcagcttggctctgtgcgtattggtgatcgcgttgagattggtgcttgcaccaccatcgaccgcggcgcgctggatgatacggtgattgaagataacgtgatcatcgataatcagctgcaaatcgctcacaacgtgcacatcggatatggtagtgcgctggcgggtggtacagtaatcgccggcagtacacgcattggcaagtactgtattattggtggcgctagcgtgattaacggacatatcgaaattgccgatggggtgaccatcactggcatgggtatggtgatgcgcagtattgaggagaaggggatgtactcttcgggtattcctctgcaaaccaataaagagtggcgtaaaacggccgctcgcgtacaccgtattgacgatatgcataagcgactgaaagctttagaaaagttgcttgagcaatccgacacggtacagcccgataactctcaagctgaataagctggtttcaaaggctcgcacattgcgagtcttttcgctgttgggtattcccttatttttctatttacaaacaggatgatgactttgactactgataagaaaacgatgaatatcactgaaattcaatcgcttctgcctcaccgctatccatttttactgattgatcgcgtgaccgactatgaagaaggtaagtacctgattggtttgaaaaatgtttcagtgaatgagcctcagtttacgggtcactttccacaactgccggttttccccggtgtattgattttagaagccatggctcaagccactggtctgttggcgttcaaaacctttggtgcgccaaaagagaatgaactgtactattttgccagcattgatgaagctaagttccgtaagccagtgacaccgggcgatcaactgatggttgaagttgaattccttaaagagcgtcgtggtatcgcgctgtttaacggcgtggccaaagtcgatggtgatgtggtctgttctgctcaactgaaatgcgcacgtcgagagttttaagatgattcacgaaactgcacaaattcacccaacttccgtcgtggaagagggcgctatcattggtgccaacgttaagattggtcctttctgttttgtcgatagcaaagtcgagatcggtgaaggtactgagctgctatcgcacgttgtggtcaaggggccaactaaaatcggtcgcttcaaccggattttccagtttgcttcaattggtgaagcgtgtcaggacctgaaatacgctggtgaagatacgcagctcatcattggtgatcgcaatacgattcgcgaaagcgtcaccatgcaccgcggtacagtgcaagataaaggcatcactatcgtgggtagcgacaacctatttatgatcaacgcccacgttgcgcatgactgtgtgattggcgatcgctgtatttttgccaacaacgcgaccttagcgggtcacgtaaaagtgggcaaccaagcgattgtgggtggcatgtccgccattcaccagttctgccatattggcgatcactgtatgctgggtggcggctctattgtggtgcaagatgtgccaccgtacgtgatggcgcaaggtaaccactgtgcaccgtttggtattaacgtggaaggcttaaaacgccgtggctttgataaagcagaaattcatgcgattcgccgtgcctacaaatccttgtaccgcaatggtttgacccttgaagcagccaaggctgagattgcccaagaagctgagcaataccctagtgtgaaactgttcctcgatttccttgagaaatctgagcgtggcattattcgctaatttgtttagtgagtgagctaaccaaactatttaaagatcgctgctgattcagcgatcttttgcatttctgtactctggcgagtgtcaaaacaggggagataccacccaagtggcgaaggcttgagtatccatcagcgcatgatgaactgcggaggaaaccgtgaatagaccattacggattggcatagttgttggggagctctctggcgacaccttaggcgaaggctttatcaaagcgatacgtgctcgttacccagatgctgagtttgtcggcatcggtgggccgaaaatgaacgcacttggctgtcaatctctgtttgatatggaagagttggccgtgatgggtttagtggaagtgcttggccgcttgccgcgcctgctgaaagtcaaagccgagctggttaagtatttcactgccaatccgccggatgttttcgtgggtatcgatgcgccggattttaatttacgccttgagctgagccttaaacaagcggggatcaaaaccgtacattacgtcagtccatcagtgtgggcgtggcgacaaaaccgcattcatggcattgccgcggcgacgcatttagtgttggccttccttccatttgagaaagcgttttacgacaaattcaatgtgccttgtgagtttatcggtcataccttggcggattcgatcccgttagcgtccgataagttagccgctcgccaactgcttggtctggatgagcagcgccgctggttagccgttttgccgggcagccgtggcagtgaaatgaagatgctcgcggagccctttatcgccacctgtcaaaaactgcaggcgcgctatccagatcttggctttgtggtggccttggtgaatgctaaacgtcgtgcgcagtttgaacaggcttggcaacaagtcgctcctgagctgaattttgtgctggtggatgataccgcgcgcaatgtgattactgcagccgatgcggtgatgcttgcctccggcacggtggccttggagtgcatgctgcttaaacgccctatggtggtcggttatcgcgtgaatgcctttacggcctttttggccaaacgtctgctgaaaacgccgtatgtctctttgccgaatatcttggcgggagaggaactggtgaaagagctgctgcaagatcattgcaccgtcgacaacctttaccatgaagtgagccgtttactcgaaagcgacaaccaagccttgatggacaaatttaccgaaatgcatcaatggatccgtaaagatgcggatcagcaagcggcgcaagctgtgctgcatttgattcagaaataacattaaccagattgagaagataccatggcgaagaaaccaagcattgagctgcctccctttgagattcctgcaggttatgccttgattgctggagtggatgaagtcgggcgcggcccactggtgggggatgtcgtcacggcagcagtgatccttgaccctaatcggccgattatgggcttgaatgattccaaaaagctcagtgagaaaaaacgcttagccctgtttcctgagattcaggtaaaagccttagcttgggcggtggggcgctgttcgccgcaagaaattgatgagctgaacatcttccaagccaccatggtcgcaatgcagcgcgccgtcgcagggttgcgcattcagcctgatttggtattgattgatggcaataaaattcccaagctcccaatggaggcgcaagccgtggttaaaggcgatctgcgtgtcgcgcaaatcagtgccgcttcgattattgccaaagtgatccgcgaccaagagatggaagcgttggataaacaatatcctcagtttggtttcgccaagcacaaaggttacccaaccgccgcgcattttgctgccattgagcagcatggagtgattgagcagcaccgtaaaagttttggcccagtaaaacgtgctcttggtatagaatagagcgcaattgcgtttcctaagatttggatactccttgcatgtcagacccaaagttcatccacttacgtatacacagtgatttctctatggtggatggtttgtccaaagtcccgccattggtgaaaaaagtggcggcaatgggcatgcccgcaatggccttgaccgatttcaccaacctgtgtggcttggtgaagttttacagcaccgcgcataactgcggggttaagccaatcattggcgccgactttactttgcaatcggaagagttcggtgatgagctgaccaaactgaccttgcttgctaaaaacaatgtcggttacaaaaacctcaccttattgatttctaaagcctatttacgcggccatgtccagcatcaacctgtgattgataaagcgtggttggtcgagcatgccgaagggctgattgtgctctcgggaggcaaaagtggcgaagtggggcgcgcattactcaaaggcaaccaacaacaagtagaaagatgcattgagttttaccaaactcactttgccgatcatttctatctagagcttatccgcactggccgtgctgatgaagagagctacttacattttgcgctggatgtggcagagcagtacgacttgcccgtcgtggcaaccaacgaagtggtgttcatcactgaagagtcgtttgaagcccacgaaatccgagtcgcgattcacgatggttatacgctggaagatccacgccgtccgaaaaattacagtccgaagcagtatctgcgcagcgaagcggagatgtgtgagctgtttgcagacattccagaagcgttagccaacagtgtcgagattgccaaacgttgtaacgtgaccgtacgtttgggcgaatatttcctacctaacttcccaacgggcgggatggcgattgaagattttctggtgatgaaatctcgcgaagggttggaagagcgactcgaatttcttttcccagatccagaagttcgtgccaagcgtcgccctgaatatgatgagcgtttgcaagttgagctcgatgtgattaaccagatgggctttcccggatacttcttgatcgtgatggagtttatccagtggtcaaaagataacgatattccagtcggtccgggacggggctcgcgggggcgggctcattggtagcgtatgcactgaaaatcaccgaccttgatccgctggaatacgatctgctgttcgagcgtttcttgaatccagagcgggtctccatgcccgacttcgacgtcgatttctgtatggataagcgtgatcaagtaattgatcacgtagcggaaatgtatggtcgtgatgcggtatcacaaatcatcactttcggtaccatggcggcgaaagcggttattcgcgatgtggggcgtgtacttggtcatccgttcggttttgtcgatcgcatttccaaattagtgccacccgatccgggtatgacgctcgagaaagcctttatcgccgagcctgcactgcaagagctgtatgacgcggatgaggaagtcaaagagctgatcgacaagtgtcgaattctggaaggctgtacccgtaacgctggtaaacacgctgggggcgtggtgatttcgcccactgccatcactgactttgcgccgatttactgtgatgcggaaggcaacttcccggttactcagttcgataagaacgatgtggaaactgccggtctggtcaaatttgacttcttggggctgcgtacccttaccattattgactgggctttgggcttagtgaacccgcgtttgaaaaaggcgggcaaaccccccgtgcggattgaagcgatcccgctcgacgatgcgcgctctttccgtaacctgcaagatgccaaaaccaccgcggtattccagctcgaatcgcgcggtatgaaagagctgattaagcgactgcaacccgactgttttgaagacatcatcgctctggtggcgctgtttcgtccggggccgttgcaatccggcatggtggataactttatcgaccgtaagcatggccgagaagccatctcttatccggatgaaaagtggcaacatgaatcgctcaaagagatcctagaaccgacctacggcatcatcctctatcaggagcaggtgatgcagatcgcgcaggtactgtcgggttacaccttgggtggggcagacatgctgcgccgtgcaatgggtaagaaaaagccagaagaaatggctaagcagcgcgctgtgttccaagaaggggcggagaaaaatggcgtcgatggtgagttggcgatgaaaatcttcgatctggtggaaaaattcgccggatacggatttaacaaatcgcactctgccgcttatgcgctggtttcctaccaaaccttatggttgaaaacccactatccagccgagtttatggcggcggtaatgaccgcggatatggacaacacggaaaaagtggttggcctagtggatgagtgtaaaaacatgggattgaccgtgttgccaccggacattaactcgggtctttatcgctttaacgtcgatgacaacggcgcgattgtttatggtattggcgcaattaaaggggtgggtgaaggtccgattgaagcgattttggaagcgcgcaacaaagggggatatttcaaagatctgtttgatttctgcgcgcggattgatctgaaaaaggtcaacaaacgggtaattgaaaaactgatcttggctggcgccctggatagattaggcccgcatcgcgcagccatgatggcctcagtggatgatgcggtgcgtgcagcaagccaacatcaccaagcggaagcgtttggacaagcggatatgttcggtgtgctcacggatgcgccagaagaagtcgagcagaaatacacgcaagtgccagaatggccagaaaaagtgcgtttggaaggggagcgcgagacgcttgggctctatctcaccggccatccggtggatgaatacctgaaagagctcaccaaatacaccagttgccgtttgaatgaagccgcaccaacccggcgtgatcaatccttaaccgttgccggattggtgattgcagcgcgggtgatgaccaccaaacgtggcacgcgaattggtttaatgactttagatgaccgctcgggccgtatggaagtgatgctttactcggaagcactcgatcggtatgcagaatggttagaaaaagataaaattctggtggtttccggacaggtcagctttgatgacttcaatggcggacttaaaatgtcggcgcgcgaggtcatggacttgggcagcgcgcgtgaaaaatttgcccgcggtttatcgatctcgattttacagtcgcagattgatcaacaattttttgagcgttttagtcacatactggaacctcaccgcgcaggaaccgtacctgtcaatgtatactaccagcgccctgatgcgcgagcgcgcctgacgttaggcacagagtggcgagtcacgccaagcgatacattgttagacgaattaaagcagctacttggtcatgatcaggtagaactcgaatttaactaaaattcagccagtgcgcactgagggtggcatggctgagtcacaaaggatcgatagatgagcctcaattttcttgattttgaaaaaccgattgtcgaactggaaacgaaaattcaggcgctgcgtgatgtgtctcgtcacagcacaagcgcatccgtagatctggataaagagctagaacagcttgagaagaagagccttgagctgaaaaagaagattttcagtgacttaggtgcatggcaagtcgcgcaattggcgcgtcatccgcaacgtccttatacgctggattatctcaaacacatctttactgagtttgatgaactggcgggcgatcgcgcctatgccgatgacaaggcgatcgtgggcggtattgcacgccttgaaggtcgttcggtcatggtgattggtcaccaaaaaggtcgtgaaacccgtgaaaaggtcaaacgtaactttggtatgccaaagcctgaaggctaccgcaaagcgctgcgtttgatggaaatggctgagcgtttcaatatgcctatcatcactttcattgataccgcgggcgcatacccaggtgtgggtgctgaagagcgcggtcagtcggaagcgatcgccaaaaaccttaaagtgatgtcaggcctgaaggtgccagtcatatgtaacgtggtgggcgaaggtggctctggtggtgcgttggcgattggtgtcggtgactatgtgaacatgctgcaatactcaacctactcagtgatttcaccagaaggttgtgcgtcgattctgtggcgtgattctgataaagcgccacaagcggcagaagcgatgggtctgattgctccacgtttgaaagagctggagttgattgacgaaatcattgaagagccactgggcggtgcgcatcgtgatcacaaacagactgcagagaatgtaaaagccacgctactgcgtcagttggccgatctggatgcactggatcacgaaaacttgctggagcgccgctatcaacgtttgatgaactacggttactgttgattgcggttactgttgattatttcatcgcgcagtggcggtggaatatccacatatagaaagggttggcttaggtcagccctttggcttttctgggctcaaggggtaaacttgagccacttttctcaactctctgtggtttatggacgatctctatctccactttgtgcagcaattagctcgctatccttttcgcaaaatccttctcgcactgagcggcggcgtggattcgcaagttctgcttgcccttctggcgcgtggacgcgatgagtttggttgggatgtgaccgcggttcatgttcatcatgggttgagcccgaatgccgatcagtgggcgcagtattgccagcgctgttgccgtgaagtcggcatggcctgtcaaatcgaatatgtacagctggatgtggcaagtggtgaaagtattgagaaactggcgcgagaggcgcgttatcgagtccttgctccgcatgtgaatgcgcagacactgttgttacttgggcagcatgctgacgatcaactggaaacttttttactcgcattaaagcgcggcagtggcccaaaagggctggccgcaatggctgcttatgccccgtttgccgagggacatttgctccgccctctattaaccgtctcacgtcaacacattgaagcctatgccaagcagcacaaactcacttgggttatcgatgaaagtaatgcagatatccgctacgagcgcaattttctacgccatcaggtgacacctgtacttaccgagcgctggccgagcattcgccaagctgtgcaacgtagtgctgagctgtgtgcagaacaagaagcgctgctgcaagagtttttagctgaagcattaaaaaaggcgatcactgctgagggcggattgtcgatcgccgttctggctgagggcagtgagggaatgcgtcgacaactgatccgagcttggtttgcgcaccataggctaccgatgcccagtcgtcagcacacggagcgtatttggtgtgaggtggcgctggcgagtgaggacgccaatccaaaattaaagttgaaccatattgaggtgcgccgttttcagcactgtctgtacctcgtgccaccagaaaaagatctttcaggctggcgcagtgcattagtgcctgaacaacgtttgccgttgccgcaaggtctaggtcatcttcagttgaccagcaaggcaggtggaaatatcaagctgcccgatgaccccagccaattatgggttagctttgagccgcaagggctagaggcttgtcctgttgggcgggtgggttcgcgcaaactcaaaaaactgtttcaagaatatggtgtgccgagttggcggcggcggcaaacacccatcctcatgtaccaaaatagagtggtctgtgtcgcggatttattcgtagatcgtgattggagtgggcaagattgtgagttggtttggttcaaatctcatgattctgtgccaaaataaattcataaccacacataatctatagggataattacatggggaaagcaatgaacaaaatggttatagccctcgctttgggtggctgcgctatgtctggtgccgctttggcgggggatgtggctgcagggcaagcgaaagccgcggtttgcgcagcgtgtcacggcatggatgggattgccgttattcccggctacccaaatcttaaagggcagagtgagcaatacttgattagctccgttaaagcttacaaaaataaagagcgcacaggtggcttggctgcagtgatgcaagcgcaagccatgatgctcagtgatgaagatattgctaatctggctgcttattacgccagcttgaagtgatcattatccgcttcgtacttaaagcggcagcggtgttggctaggttcgttcatctctatcacatagtgtgcctatgctcatggagatgaacccacctactgcctacctgcagtgccaagtcgttcgggaataacttctattatgctttgtttggcacctatcaatgaatacgtgcccacacctaaggtccgcgagtgttatctgcggactttttgcctttttcagccttcactctttttatctgtgcattgttgtggcacagcatacaaatctcacattcatttcacttttgattgcaaccaattccaatgatttatgctctcaatgcatgggaatgatcccgatcgtcattatgaactgtcgtagaggagcggccatgagatttgaacgaaatgatttaagtggatttttagggaagagttttatctataactatgatcagggttggcgttatgagctgtatgtgaaaaatgcgaccaccatagattatcgagtccattctgggattgttggtgggcgatgggtgaaagatcaaaccgtgcatatctcgcgagttggggcggccatttatcgggtttcttgggctgagccaactggaaccagcgtcgctctcaccttaaacttagaggattatgtcgtgcatggtgccatttactttcctcgctggattgttgatgagcctgaaaaaattgcttgctatcaaaatgaccatctccctcttatggaagcgtaccgtgatgccgggcctatctatccaacccatgtgatcgatagctttgcgaccttgatttatatgcgtgattgcggactcaataatgaacaagtgattaactgcccccccagtgagcttgctgaggattatcctttctgtttagccgataaaaacttactgccagcctaagtgtggtcatggcgtaagctgatgaagatggctttgggagcacggaaaagtctatagtggcttgagtaacaaaaggaaaaattactcaagcactttggttgattgttggttatggctgacagataatgccgagcactgacagtcgtttaagggatgaacatgaaaaaaatcgaagccatcatcaagccgtttaaactcgacgatgtccgcgaggcgttggccgaagtcggcatcacaggtatgacagtgtctgaagtcaaaggatttggccgtcagaaaggacacactgaactgtaccgcggtgctgagtatatggtcgatttcctgcctaaagtgaagctagaaattgtggtcaccgatgatgtggcggatcgctgtgtcgacaccatcattgaaacggctcaaaccggtaagattggcgatggtaaaatcttcatcaccaacgttgagcgtgtggtacgtattcgtaccggtgaagaggatgaagatgcaatttaagcatccgtccctatgattacttaataataaggagctaaggctccttattttgtttgagggtaactgaatgaaaaaacgttactggatggctccattgttgatagcggcggcgggactggccgctttctggtctatcttcacgattccgactcaacctgaattagtcactataggacgcaatcagcaaggcgaaccgctgttgtgctatcaacatccgcagtctgaagttttggatcttgatggagagctcaatctgctcgtttggaatatctataaacaaaatcgtgccaattggtcaacgcagctcaccgaattgagtcgtgaccagcaattactcttgctgcaagaggccaatatgacgcctgcgtttaaagagtggattcatcaattagggtgggatggcacccaagctcgagcttttgaagcatttggagagacggctggagtaattaatctcgctaaagtgatgccaaccatggcttgtgcttatactcagcttgaaccgtggttgaggctgcctaaatcggcgatctacgcacgatatcgtttaagtgatgggcaagagttagtcgtagtcaatctgcacgcagtcaacttcacttatggcacccaagagtatcaacagcagttgatcgcactactggatgagctacgtgattttactggccctgtgattgtggcgggcgattttaacagttggagcgaggcgcgtatggcgctgctaagtactcagcttgcctccgtaggattacaagaagtgcgcttttcgccagataaccgcacgacgtttatcaatggcttgccattagatcatgtcttctatcgtggattgcagcttgaaaaagcagaagcgcccatatcggacgcttctgatcataatcctctgttggttcgctttcgcttactcaactagcctattcagcgcagtgttatgcgctgaatttggtcacatccacatacagtttcagttgctgacccgccttgagatattgagtgctgtttaaatcattccacttaacgatgtcagcagttttcactttaaacttattggcaataccactcagtgtatcgccagagcgcactttgtaagttaccgtgcggatcacgccactcgttggtttactgtctttccagatcaccaatttctgacctttacgcagcgcatctttcggtgccatgccattccatttcgccagagattggtaaggcacgttatactgcttggcgatggtccagaggctttcccctgagttgacggtgtgcgtcaactgatactgtccacgtggcacggattgggtcttggctaagcgattgctcacgctcagtgcatacgctttctcatctttcaccgaggttggtacgaacagatagctacccacacgaatttggttgctggcaatctggttggcttctttgatcactttagccgtggtgttgtacttatcggcaatggtgctgagagtatcacccgatttcaccttatagcgaaccaccttaatccctttgccgcggttctcttccatggctagattaaaacgttcaactttttcaacggggatcagcagttgatgtgggccatttggagccgttgcccattggttataggcagggttaaagctttgcagctctttaaccgttagacctgcatatcgagcggcaatcgcaagatccaactgctctttcgggtcaacggtggctaacactgggcggttttcgattgctgggatggagataccgtatttttcctgattggcaatcacatcggctagtgcaatcagtttagggacataaccgctggtctctttaggcagatccagcgagaagaaatcgataggtttacccgcttttttattggctttaatggcgcgggccacgcgcccttcaccactgttgtaagcggcgatggcgtgataccagtcaccatcgaagtgttggttcaagacagtaagataatccagcgcagcgtctgtggcggcggcgacatctcgtcggccgtcataccagaaattttgtttgagaccataacgcttgccggtagacgaaataaactgccataagcctgcagcactgccgtgggaataggcaaaaggatcgaacgagctttcgacaatcggtaacagcaccaattctagcggcaggccgcgttgctcgactttttcagtgatcagatagaggaaaggttcagcacgactggcaatcgcttgtaagtgacctgggtttttgagaaaccattcgcgttgtgcatcaacacttgggtctttggggatgccgagcttgaactgcatagcaatgcgttgccatacatcgtcttgttcttgtggtgtcagcgcgacgcgctcttcttctacactctccgtttcgccagcaggcagagttgcagtcgtttgcggcttacgcttttttttcacggtagcagattgagtgggcgggtttaccgcttggtcatctgatgtggtcgtatccacaggttggggggattgacagccaacgagcagcaacgccaatacccaactgaatttaactcgcatgtaacacagcccttattcttcatggctgctgataatacttgccactttgtcttggtgacaagcgacaaaagtcaaaattcattcttccattcacgtaatgcagtaaatattgtgagcggatccagcgttgacacttggctagccactgagcgaataacactcggctcttgcgtgcgtaaaaaaggattgacccatttttcacgccccaatgtggtggggagcgttggctgattttgcgcgcgtaaacgactcacttcatcacgataaatatgcagttgttcgttttcgggctctaccgctaatgcaaaagccacattggcggcagtgtattcgtgtgcgctgtaaacttgagtctcttcaggtaggctgagcaacttattcaaggaagaaaacatctgctccatcgtgccttcaaatactcgcccgcagcctgcagaaaacagcacatcgccgcaaaacagcttgccatcaccaacgtaaccgatatgccctaaggtgtgtcccggcagaccgagaaccataaagcgttcatcaaacagttcgatttggtcgccatcttccaccggatgagtgagagttgggatgggctcttgtgctgggcctaccacatggatttcggggaactgatgcacaagctcagcaacgccgccaatatggtcgtgatggtgatgggtgatcagcacggcttttaagtttaagtcatgctgtttaaggtaagcgaggacaggctcagcactgcccgggtcgaccacagcacagtcgcgatcgcgattttgaatcagccagatgtaattgtcgtcaaatgcaggtatgcttttgatctgtaacatgagttgtctccggttaccttgatgaagcgggtgagcaatgaaaccagcacgcagtgataaagcgcttgaaaatccacactcatgggctcaattgaaaaatggccaatgggtgagtgaatctattcagacccgtttagatgaatggtgcccaaaactttttggttaccatatgttaaagctcggcggtctgagctgtgagcttgccagttgtacctgcaatattcaacaccaagtacacctcgatattgaaaatccgttgcatacggtgattgccgataaatatgagctgccgtttttggagaagagtattgatgtggcgattttggcgcatcaactcgactacagtaacgatcctcaccgtttattacgggaagtggatcgagtcttgattgatgatggttatctgatcatcaccggttttaacccaatcagttttattggcttagccagcctgatgccttggcgcaaaaacaacttaccttggagtgggcgaatgtttaccccgaatcggattaaagattggctaagcgtactcaattaccaagtggttgcttgcgatcagtacgccttgtttccgatgcaaaaataccgacctttctggacttggttggaaaacggcctcggtggctcaaattcgccctttggtagcctgtactttattgttgcgcgcaaacgtacttgcccactcaagccgattcgttctaaatggcgtttgaagcgaagattatcgccgattggggtcaactatcgagttaatagtaagtcgcagtcgtgacgctcttttgaactctcattctgagcctctgtggttcaaaacgagtgcctttttgctgattgagcttctgttattggggttcaggttgatagccgatatcgtcttcggtgggattttctgccgcttggcgggcaagttcatcacacatttcgttttcacggtgtcccgcgtggcctttaacccagcgccattcgacttggtggcgagcggtttctttgtcaagggcttgccataagtcggcatttttcacgggttttttgtcggcagttttccaaccacgcagcttccagttgtggatccactgggtgatcccttggcgaacatactgactatcggtcgtcaggatcacgcgacagggttctttaagtgcctgcagagccatgacggcggccagcatttccattcggttgttggtggtgaggcgataaccgcgagcaagggtcttctcgacttgtttataacgcatcacgatgccataaccgccgggacctgggttgccgaggcaagaaccatccgtgaaaatttccacctgtttgttcatgatttgatactattgggtcacgcaaagaattggcatagtctgacatagatatcctgatgaatactagcaacaatgcagaataccaacgcatcgtggtgctcgataccgaaaccacgggtatgaaccgcgaaggcggcccccattacgagggacatcgaattattgagatcggtgcagttgaaattatcaaccgtaaactcaccggacggcattttcacgtctacttaaaaccagatcgcgatattcaattagaggcgattgaagttcacggtattaccgatgagtttctaaaagataagcccgagtacaaagatgtccatgaggagtttgtagacttcatcaaaggggccgagctggttgcccacaatgcaccgtttgacgtcggctttatggattacgagtttgctaaactcggtggtgcgatcggtaaaaccagcgatttttgcaaagtgaccgatactttggcgatggccaagcggattttccccggtaaacgcaataacttggatatcttgtgtgagcgttacggcattgataactcacaccgaaccctgcacggcgctttgctcgatgcggagattctagccgacgtttatctattgatgaccggtgggcagacttcactgcaattttcatcggtcacgcaaaatagtggggaattgagcgcagaatcgttaaaacgtgctcgttcagagcgaaaagcgttaaaggttttagcggctagcgccgatgaactacaagcacatcaagatcgtttggacatagtggccaaaagtggcacttgcctatggcgtagttaggagaagttatgttgaggattctcgcggcgatagtgggatgtttgatcagtttgagtagtctagcggcacaacaatctagcatgtcgctgctcgataaccgttttcgcgttgatccgaccataacccaaatcacctttgtgatttaccgcgaaaaagattctcaaccagtcgtgttagttcgccctgatggcagtaagtattatcagtggcgtaatcctgaaaatgtgcgctggtatcaagaatcctcgatggacatcatctcgattgagaatcctatgccggggccttggcaggcaatcggtaaagtcacaccgaaaaacaacatcaaacttatctccaatctacaactcacgaccgacgtctttccgagccgagtgtttcaaggggaagaatttaaatttaccgcacgcttaacgtcggacggtaaacctttgctattgcgcgactttttagatcgagtcaacctcaaagtgaccttcaccaagtttgttgaaaatgaagattctctcgctaaggaagcacgacccatccccgaagtgctcggagaatttgccgatgatggtactttgcttgatgaaaagcccggcgatggcgtgttcacggtggctttaaaaatggcgattgaaccgggcaaataccgtgtacgaattacctcaggaaatggcgtttttctgcgtgcgcaagagcaagaggtgttagtttacccaacgccgatttcgaccactttcattcaatcgcgcttaacgggcgcaccgcatcaggtgctgtttacgggagagcaggggatgattgagcccggttcattagtggctcatattcgtcatcgccacccttatcaagatgattacatcgcgcaggcgcaatcaggcaaagaatccttgaccgctaagttgaccattccctatgacggtcagtttggtaactactcttgggatggaaaagtgtgggcgaccgaacttgcttcacaacgtgaactctatttcccgattggcgatcaaacctacagtgtggtcgatgagcttaatattgccgaagtgcgtcgaattcaggaagaagaggaagctttacgcctgaaacaagagcaagagctgttgatcattcagatgcgcgaagagcagcgtagccgcaacatgatgtacatcatagtaggtaatatcgtggtactgatcttggcattagccgtttggtttgtactgcgtaagatcaaaatgaaaaaagctgctgtaccggaaatgcagctaaatatgccgcctaagaaggggaagtaaaggcgttgaatttgcctttgaccttttgaggtttgttgttcaagcggatttgaatgaaggctcacttgagtttatgaaacataagaaaagggagacgttgtctcccttttggctattgaagtggtgaatactgctcaatgtggaacttaagccacttcagctttacgttgtgtgcgcttttttgcggccagctcttgtggggcaaagtcatcgacattgatggtgtagagacgatgcgcttccgcttcgctcagcagtgccgcttcctgaatggtcagcactttggcttctaagcccagcttggcgacttcatccaaccccataaatgggcggcgttgaccaagcgctttgcacgctttttcaaacagcggctcagcttgtaaaatcacattcaacgcttgttctatcttacccgcaggattgttatcactcggtgttaagtattggtgacgaccaattcttgaacgtgtttcactcggggtttgcaagatctgcgcgagcttgctatcgagcttgtcacttggcgctttacgcacacggccgaaaggcatcatgagtacacgtaatgcgcggccaataatccgatttgggaagttagccaagaactcatcaatggcgatttcagtttggcgcaaactatcttgtaagccccaatggaccagtggtaaatcttcggctggacggccatcgttttcaaaacgttttaaggtcgctgagcttaagtaaagctggctcagaatatcccctaaacgggcagagagacgctctctacgtttgagtgaaccgcccaatactgccatggagatatccgcaagcagggccaagttagcactgtaacgattaagctgttggtagtagcgcttggtcgcatcacgggttggtgcttgtgaaccataaccatcagtcaaaccaagccataggctgcgcactaagttgctgagcacaaagccaacgtgtcctgctagggcactatcaaatttttctaccgcatcagaatttgggctataagccgcttccatttctctgagtacataaggatggcagcgaatcgcaccttgaccaaagatgatcatcgagcgggtaagaatgttcgcgccttctacggtaacggcaattggagcaccttgatacccgcgagcgaggaagttagcggggcctaaacagatgcctttaccgccgacaatgtccatcgcatcaataattgagcgttgtccgcggtgggtacagtgatattttacgatcgcagaaattaccgaaggcttttcaccgagatcgatacccgcgacagtcaggttgcttgctgcatccatcacataagcgttaccggctaggcgcgctaatggctcttcaattccttccatctgaccgataggttgtttgaactggcggcgaatacgcgcataagcacctgtagcgagtgccgcagttttaatgccgccggttgagttggaaggtagggtaataccgcgtcccaccgaaagacattccaccaacatgcgccagccttggcctgccatttttggaccaccgatgatgaaatccagcggcacaaacagatctttggcacgggttggaccgttttggaaaggcacgttgagtgggaagtggcgattgccgatctccacgcctttaagatgcgttggaatcaaggcacaggtaatgccgagctcttctttatcaccgagcagtccttcagggtcgcgcagtttaaaggcaagccccagcacagtcgccaccggtgcgagagtgatgtagcgcttgttccacgtcaggcgcatacctagaacttctttgccttcccattgtcctttacaaactacaccgaaatcagggatagaacctgcgtctgaaccggcttctgggctggttaaagcaaaacaggggatctctttgccttccgctaagcgaggtaagtaatagtttttctgctcttcggtaccgtaatgttgcagcagctcaccggggcctaaagagttaggtacgcctacggttgaggagagaacaccagaaacaccggtcagtttttgcagcaccaaagattgtgcataagctgaaaattctaagccgccatactgttttttgatgatcatggcgaagaatttcttctctttgaggaaagtccacacttctggcggtaaatctgccagttcatgggtgacttggtagtcgctaaccatggcacacacttcattgactgggccatccaggaaggcttgttcttcagcagacagcttcggagcttggatattgtgcagctttttccagtccggcttgcctttaaacagttcggcttcccaccaaactgttccggcctcgagggcttctttctcggtctgtgacatcgcgggcagtacttttttaaacactgctaatgctttaccactgatcaacgattggcgaacggatggcagacagagcacgacgacggccgccaaatagagcgcccaaccgaaaaagccaacaggcccaaacagtgaaagcgctagcatggtgaaagtcagtgctgctaatgaggtaaatagggatgttctttgatacaggcatgcgccgagtatcaagagcatgattaaggtagagagcaagatttccatactgttttatcctttttcagactcgcgttttctatcagtagatacgaaaatcgcgactctaagtttagtggtctaaccagttaaagtgtaaccaaaatattaatgaaatgtaaaacggcattttgtccgaaagtgatcacgctagagtaatctctctactcttgccgcttcttgaatgagtggatttgctaacgaggagtaaatcttgctttttgactatcgacagcttcgcttgtttgggtaaactcaggtggatactgaattgaagtgccaagcgcgcgggttcggataactaataatcaatagagagatacctcatgtaccaggatttaattagaagtgaactgaccgaagcggcagacgttttgcagaaatttttgagtgatgaccacaacatcgcacaaattgaagcggcggctaagctgattgctgattcgttcaagcaaggtgggaaagtgctttcttgcggtaatggtggttcgcattgtgatgccatgcactttgctgaagagttgactgggcgttaccgtgaaaaccgccctggttatcctggtattgcgatttctgatccaagccatctgtcttgtgtgagtaacgattttggctatgactatgttttctctcgttatgtggaagcggtcggagcgaaaggcgatgttctgtttggtctgtctacctctggtaattcaggtaatatcctaaaagccattgaggcggcgaaagcaaaaggcatgaaaaccatcgcgttaaccggcaaagatggcggcaaaatggcgggtttagccgatgttgaaattcgtgtgccacattttggttacgcggatcgtatccaagaagtgcacattaagatcatccacatcatcattcagttgattgaaaaggaaatggcgtaaccctacgctcaagagcccggtattaaccgggctactggtttaagtaaggagtggtttaaaccatgtgtgaattgctcggcatgagcgccaatgtaccaaccgatatctgttttagtttcactggcttgatgcaacgtggcgggaaaacgggtccgcatcgtgatgggtggggaatcgcgttttacgaaggcaaaggctttcgcaccttcaaagatcctaatcccagcagtcagtccaaaattgccgagttagttcagcagtatccgatcaaaagtcgtgcggtgatcagccacattcgtcaggccaatcgcggtggggtgaatctggaaaacactcatccgtttacccgcgagttgtgggggcagtactggacgtttgcccacaatgggcaattgacgggatatcaaaatctagtcactggacgccatcgaccagtcggtgaaacggacagcgaactggcgttctgttggttgctgaatcaaatggaacagtgttaccccgaaggtccacaagattggcctgagatgctgcgctatgttgcgcagtgttgtgatgagcttagagctctcggtgtctttaatatgctgctgtctaatggcgaatatgtgatggcgtattgcaccaatcatttgtattggattactcgccgagccccatttggctgcgcggcactgctcgatgaagatgtcgagatcaatttccaagaagaaaccacgccgaatgatgtggtgtcagtgattgcgactcaaccgttaaccggtaatgaaacttggcagcgtatgaagccggggcaattcgcatttttccattttggagagcggatagaagacaatgcacatgtgttgatggatgtgggttttgcaccgaatcgacccggatgtcaggcaccaagccaacctctcgactaagcgatatacctttcctacttgaagctgcagcggtgttggctatgttcgttcaccccaatcacatagtttatgttgtctgggaataaaaagtggtacaaaaagaaagggttgaatgatttcaaccctttttcgattggagattattcggctgcgtaaccgtgtatgccgagcgcttcgccatctaaataagctttgccgtctttcattgctaaacgctcttcgacaaaccatttcacgacaagcgggtagatgcgatgctcttgatcctgcacgcgagccgtgagctcttcgaccgtgtcatcttcaaaaatcggtactttggcttgcagaatgactggaccgccatcgagctgctcagtgacaaaatgcacgctggtaccatgctcttcatcgcccgcgtggatagctcgttgataagtgttcagtcccggatactttggcaataacgaagggtggatattgatcatgcgccccagatagtggcgaacaaattcgctactgagaatgcgcatgtaaccggccagcaccactaagtcaggagcaaatttatccatttgctccatcaatgccgcgtcaaaagcatcacgagtttcgtaagctttgggatcaataaaacaggcggctgcgccagcctgtttggcacgttctaaaccgtaagctgttgctttattggaaaacacagccgtcactttgccatcttgaatactggttgcacaagcatcaatgatcgcctgtaggttggttccgtttcccgaaattaaaacaacaatactcttcatgcttagttgatctctacctgtgcttcgttgctattggcggctgcgatttcgccgatgacccatgcggtttcgccttctgcttgcagtagcgcaacggccgcattggcttgatcttttggcagtgcaatgatcaaaccgacaccacagttgaaggtgcggtacatttcgtgagtggtcacgttacctttttcctgtaaccattggaaaatcactggccattcccagctcttaccatcgatcacggcttttgtaccttctggcaatacgcgtggaatgttttcccagaagccaccgccagtgatgtgtgaaatcgcatgaatgtcatgttcagcaatcagctttaagccagatttgatataaattttggtcggtgcgagtaagtgctcaccaatggttttgcctgctaaccgctcattcttatcggctttagagacttctaaaatcttacgtaccagcgagtaaccgttggagtgtgggccgcttgagccaaccgcaatcagcgcatcacccacttgtaccttactgccgtcgatgatctcttctttttcgacgacaccgacacaaaaacctgccacgtcgtagtcttcaccttcgtacatgcctggcatttccgcggtttcgccgccaatcagcgcgcagcccgcttgcaaacagccatcggcaataccagaaatcacttcagcagccgtatccacatccagtttgcctgtcgcgtaataatcgaggaaaaacagcggctcagcgccttgaacaatcagatcattgacgcacatcgccaccagatcgatacctatggtgtcgtgttttttcatatccagagcgagacgcagtttggtacctacgccgtcagtgccagagactaaaacagggtgcttgtatttggttggcagttcacacagtgcgccaaaaccacctaggccacccataacttcagggcgacgggtgcgcttcacggcgcctttaattcgttcaacgagtgcattacctgcatcaatatcgacacctgcatctttgtagctgagagatggattattaccgctcacggggaagttcctcggtctagttggatatgaaaacggcgctattctacagggcttaaaacaaaaaggaaaacgtttgcgtaagatttttatccggttttacagtcggaaatatccacaaaatgagtgtataatccgcaggtttaaattaatgaagccggagttggacatgaaaattgttgaagttaagcaccctcttgtaaaacacaaacttggcctgatgcgtgaaggcgatatcagcactaagcgttttcgtgagcttgcaactgaagtggcgagtctactgacttatgaagcgacttctgactttgaaaccgaaaaagtcacgatcgaaggctggaatggtcctgtgcaagtggatcaaattaaaggtaagaaagtgacggttgtgcctatcttgcgtgcaggtcttggcatgatggatggtgtacttgagcatatcccaagtgcgcgtatcagcgtggtcgggatttaccgtgatgaagaaactcttgaaccggttccttacttcaataagttagccactaatattgaagagcgtattgccatggtggttgacccaatgctggcaactggcggctcgatgattgcgacaattgacttgttgaaagagaaaggctgtaaccagattaaagtgctggtgttggtggctgctccggaagggattgccgctttagaaaaagcgcacccagatgttgagctttacacggcggcgattgatgagaagctgaacgacaaaggctacatcgtaccgggtcttggtgatgccggtgataagatttttggtactaagtaattttgaatgaggaagccacatggcttcctcattatctttcaccgttcatagcccataccccacagccaacagcgatactccctgtctatttttgcgatctattcctacttttattgcaatgcattgccaaaaagtcgcggataaatgaatagccctcacagcactgatgcatctatcagttctttctaacgcatcaccgagagttaatggcaacatagccagtactcggtatggtatatggattacgtttcactcattacactcgcttattagaacaaaggatgcgcttctgttttccactgatggagcagaagattgaagtaagcagtactagcaggatgctcattatgacgcgaaagaaatttagttggattcttgtcaccctgattatttttggtttttttgtaacgagcttggtcagctataaagtggctcatgacacgcttgaagagcaaatcaataaagattcactgccattgaccagcgataatatttattcggaaattcagcaggatctgatccgtccgatcttcatctcctcactaatggctcaagacacgtttgtgcgcgagtggactttggcgggagagcaagacccagaaaggatcatccgttatttgcgtgaaattcagcgtcaatatcaaacgatctccagtttctatatctcggatcgcaccggtcattactaccactacacaggcatactcaaacaagtatcggaatcgaatccgaatgatgcttggttttatcgcgttaaaaactccgcgccagataagaattttgaagtcaatatcgacatagataccgcgaatagccaacaaaccgtggtgtttgtgaattacaaagtgtttgattttgaaaatcgttttctcggtgtgattggggttgggctgagctctgatgcggtttccgcattagtcgagaaatatcaaaaacggtataaccgccacatctatttcatcaatgagttgggagaggtgactttacacggatctcaccatccggggtttgatcagattcagcagcgtgaagggctcaaaaccttagccactcaaatcctgacctctccgagtgtgggtgctagctattatgcggacggacagaaagtctacctcaatagccgttgggtcgatgagtttcagtggtacatcattgtggagcagaaagatgagtttaatcacgacatctggtttaaagcgacattaggcaatttagccatcagtgcttttgtggcgttgggagtgcttggtttagcgcaaatgagttttcgaggctatcaaaaacggctggaagatatggcggtgcgcgataaattgaccggagcatacaaccgacaagtttttgaagagctcgtcgatgacgctatttctttggccaataaagagagtcaccctttaagtctggctgtgatcgatcttgaccatttcaaacaggtgaatgacaactatgggcatcccgcgggggatctggttttacaacgggtggttgcactgtgtcagcgtcatattgctcaggtaggaactttgtgtcggtggggcggtgaagaatttgtggttttgctgccgcatatgacgcagcaagaagcctatcagcgtatggagagtatccgcgctgagattgctatgcacgcgagccaaccacaagttaccgtcagcattggtgtggtgcaataccagcagaatgagagtttgttacatctattcaatcgtgcggatcaagctatgtataccgcgaaaagcgaagggcgtaataaggtcgttggcttgtgatggataatcaaagtgggggaagccaagacttccccatttttgtatcaaagctccccctagctaggctagggggttaagcttggagataaaacgaaatttatttcgattttctgaggcttaaagtgccaccggtgcgcggtgttggctttgagcctgaggctgtattggatgatgggctagacggacgacgctgcgcttttttcgaatttggcgcatggcgaaactcttgtgcatttttaccatggtaggttttggggttacggcgcgctttggattctttgttggcttcacggctatcaaatagcttggcatcggtcgcacgtttaatcgtgtcaccactttgcgcgactcgtgaggcttcttctgtaccgctggagtcttcacacatagccagaatctcgctcacttccgcttcgcttaaataacgccatttaccgtttggaatgccatctagcgtgatgttcatgatccgcacgcgtcgcagtttaaacacttcatatcccaaggcttcacacatgcgacgaatttggcggttcagtccctgagtcagcacaatacgaaatgaatattgcgtctcttgagtcactttgcagggcagagttaccgtatcgaggatgtttaccccagaagacatttgacggataaattcaggcgtaatgggtttatcaactcgaaccacgtactctttttcgtggttatttcccgcacgcaggatcttattcacgatatcgccatcattggtcagaaaaatcaggccatcagacggcttatctaaacgacctattgggaaaatacgtttgtggtgaccaatgaaatcaacgatatttcccggaacatcacgttccgtcgtacaagtaatgccagtgggtttgtttaaagcaatataaattggacgctctttgctacgcagaggcttaccgtcaatacagacttcatcttgctcggtgactttgcttccgacttctggctgtaggccattgagagttactcgcccttgctcaatcagcttgtcggcttcacggcgtgagcaatagcccgtctcactgatgaatttattgaggcgtttttcagtcggttgggacatacaatctcctaacgtttcacaacggatggtgcacaaaatccgcgcattctaacagctttacctacttagccaagccgtttctggtgacgctcacggttttcggcttttttctcggcactcttacgaagtaagacataaaccgcgccggtgccgccatgtaagcgttgagctgaatgagcacactgcacttcgctgatttgagtcagccaatggctgacaaaacttttcatcagcgctggtggggtagagcgctcgccacgaccatgcacaatcagtagggtgcgaatatccatcgccatacattggcgaataaattggatcacttcactgcgtgcttctttgagcgtttttcgatgtaagtctaagcgtgcttgaatagggtacttacccaatctgagcttgcgatacacgccatcttgaacgccatcccgcttaaattcgagcatatcatcaggcttaagcatgggggcatgatcgatggatagcgcctcggggtcatggtctgccaagcttactgccgcttctcgcttagccagttgagcttcggtgacttggtgggcttttttgagttcaaccgtatcatgggtgatggttttgacatcgcccatcatttgttgaaacagttctaaatcctcttgcgacataacggcacatcaaagttatttcacatggtgctgattatatacttctcatttagcaagttgcacggagttgtgcgtggaaggggagtgatgttgaggataaatgcacaataaaaaaccggagcagacacgcagtcggctccggtgcatagcgtttttctatctttcaatagaggctagcgatctagtgaggagatttgtccgtcatcactttgtagatgaagaaaccgccatagaacagcataagacctaaagcgcccaagatgactatcattgaagagagtccaactgcattaccaaaaagaagatcgagccagaagtccatgtttcctccaaagtgttgaagacgagttaacgttaaattctggctatatttgcagcactgatctggatcaattgtgttgcataggttgcttatatgtttctaatgttgagttatgagtcacattttttacgtgctttgctgctgttttgaccgaacgagagaaactcaacagaaagtctggcttcagggcttgcgcttcaagaaagaacgagtaacatacgcagcgtttcggtgaatagcgcagtttggtagcgcatctggtttgggaccagagggtcgggggttcgaatccctcttcaccgaccatatttaaggcctcagcatttatgctggggcctttttgctttatcaacatctcacttgaagcctcagcgttgtcggcactcgcttcccatcacatgatctgtcgatacttgtttggataagttcatctgccgccgacccataatgccaaatcatttgttctaccgaatagctgatttataaaaatgagcagcttgccgtttggctttggttaagctgctggatgctaaagcctttttgctcaagaatactgagcaagctctgcttgccaattaaatgcaaagtgccgacgacgaccagataaggtttgccttgttgtggtaagaattgagggtgagtgagcttctctgcccaatcccgattacgctcagtgagcatgtgggcttccaattcagcggacataccggtgagtgtgagcatttgtagcaaattcttctcatctccttttttccagctttcaatcatgcactcggtgagttgggtattgttttcccattcatcgatcaaactcaccagtaattcctgccctgagttgggtaagtgcgctaacagatccacttgaaattgtaaggtttctagactgagtataggcagttgatgctgctcagcttgttgcatgaaataaaggtcgatgcctcgatcggcttgataccccatctctaaaaattggcgcatttgcaggataaggctggctgaccatgggggctgttggcggatctgctgggcatccaacctcagttgctgcgcaatcccatccaatacaaacagttgttcatcgcttaaaacctgctcactactcaacgtcgttgcaggcaaagtgatgttggattggtgacggatatccgtctccacgactaagcctgcgctttgttttagcttttgtgcgagttggtcaggcaatggataaagctgatcgctgcccacatgcagagagcctaagaggatgagttgtgtcgaacctttggttgctgaccagtacaagggttctgcgtgaagaggttggataaatagccataaaagacagcaagcgaatcgtgtgagcatggaatgcgtgaactcctttaggttcggcaaaaacgttactttagcagtgaattaacggatttgacggagcttgaatcatgataaagctcacatcttgttgatttgtccgagccaactcacgatttgttgccgcaatcttgtgtgatgtcgatcggctttctttgcgtaacgcggattgctaagtgtgatctggattggaagaaatctcgtcaaaaatgaagtgtcgattttgacgttgctcctatatttttgaaatttaagacttttatcttggtgtcaatttgtaaagtttgaacatgatcacttggctaaaggattaattttgcgcttagaaaaaagtgccgctaaatatccctgaattttaggtaaagccattggctgatgtcgttgtgagattgggtgcaggcagagcatccctcatcgttaactaatttagggtcattattatgctgaagaagagtcttatctcgatcgcggtattcacttcattaagtggctgcgcactcaacactacgtcaccacaagaggtggtagacacattagcgaataacttggatgtgcaataccaagtggtcaacaatcacggcgcggatactggtttggcttgtcaaactctagaagctgagtgggcttcttgtaaccaagtgaatatgaccttggttaaccgtggtgaggcggtcaattcaaaagattgggctatttacttccacagtattcgcttgatcctcgatgtggggaatgaccagttcaaaattactcgcgttaccggcgacctacataaactggaacctaccgataagtttgatggttttgccgcaggtgaaacggtgactttgccgctgattggtgaatactggacgctgtttgaaacggactttatgccacgcgcttttgtcaccgcaccggatgccgagccaaaagtcattgcggctttaaataccgaggacgtggcaagctttgtcagcggactggagggtgaaaaccttaagcgcactccgagtgacaacaatgtattcgctcaagcgctgtctcgctttgaaaagaacagtgatgttgcgctgcaagatgtgacacacgcactcatcccaacgccactgcaagtgaaatcgcatagcggatctgtctctatcgctaaaggtatcgcgctgccaagcaaagcgtttgacggtgagcaaatgcaagcgctgaatgagcgcgcacaactgcttggcgtgaatctgaaaggggtgatgccggcgcaagttattatcaatcctaaatcttttaaaggtgacttggctaaatctggtgcgtatcgcctagcgattacggataaagccgttaaagtgactgcatttgaccaagcaggagccttctatgcgatgcaatcgctgctgggtttagtcgatatggccgatgccactcaactgccaaaggttgaaatcgtcgatgctcctcgttttgattatcgcggtgtgatggtggatgtagcgcgtaacttccactctaagcaagcgattctggcgaccttggatcaaatggcggcttataaaatgaataagctgcatctgcacctgactgatgacgaaggctggcgtattgaaattccgggcttacctgagctgacggatatcggcgctcaacgctgttttgacccgagtgaaacagaatgcgtgttgccacagcttggctctggtccaaacgccgataactttggctctggttatttcaccaagcaagattatttagagatcctgcaatacgcgaaagcacgtcatatcgaagtgatccctgagattgatatgccagcgcacgctcgtgcggccgtggtttcaatggaggcgcgttaccaacgtttaatgcaagagggcaatgaggcggcggccaatgagttccgtttgctggatccgcaagatacctctaacgtcaccacagtgcagttctatgatcgcatgagctttatcaatccatgtttggactcttccaaacgctttgtggataaagtgatctctgagattgcggcaatgcatcaagcggcgggtatgcctctgacgacatggcactttggtggcgatgaagcgaaaaacatcaagcttggcgcaggcttccaagatgtgaatacccaagagccagtaagttggaaaggcaacttggatctgagcaagcaagataagccatttgcgcgttcgccgcagtgccaaaacttgattgcaacaggtgcggtgagtgatttcggccatttaccaagctactttgctgagcaagtgtctaagttggttgccgagaaagggattcctaacttccaagcatggcaagatggcttgaaatacagcgaaggcgaaaaagcgttcgcaaccgaaaacacacgtgtgaacttctgggatgtactgtactggggcggctctgcttctgcgtacgaatgggctgagaaaggctacgatgtgatcatctctaaccctgactacgtgtacatggatatgccttacgaagctgacccgaaagagcgtggctactactgggcaacgcgtgcaaccgacactcgtaagatgtttggttttgcaccagaaaacttgccacaaaacgcagaaacctcactggatcgtgatggtaatggcttcagcggtaaaggcgaagtgaaaggtaagcctttctatggtctgtctgcgcagctgtggtctgaaaccgtacgtactgatgagcagtatgaatacatggtattccctcgcgttctcgccgctgctgagcgcgcatggcaccgtgcagagtgggaaaacgcctataaagttggcgtcgaatattcgcaagagactcagttggttaaccataaagcgctgaacgcagattggaatcgctttgctaacgtattaggtcaacgtgagctggctaaacttgagaaagcaggcattgattaccgcctcccagttccgggagccaagatcgagaacggtcatttggccatgaacgttcagttcccaggtgtcacactgcaatactcactggatggtcaaacttggttggattatgacgcgaagcaagcgccaaaagtgagcggagaagtttggattcgctcggtgtctgccagcggtgagcgcactagccgagtcacttcactgaaataatcgaacactcatttcactcaatggataatgaaagcctccgcatgcggaggcttttcttttgtcttttttctaaagaacaagttatggggcagcgctttgtgtctagcccttcattctcttcgataagaaggatagatcagttcccttgataagagcggtattcaaagacttggccgtgctcattaaaggcatacaccgcataactgtctttcttatcgccatattccatacccggtgaacccataggcattccgggaaccgcgagccctttggcatttttcggtgggttagccagaaagtctttgatgtcttgcgctggaatgtgaccttcaaagacataaccgccgatctctgcggtatggcaagaagctagcttaggttttacgcccagttgttgcttaatgctgtccatgttgtcatgcagcacttcttttaccgtaaaaccattctcttccatgtgtttggtccattcggtgcaacaaccacaataaggagatttgtgattcactacctgagtagcaagcgcttgtcctgaaaatgtggccaatagggcgagtgtcatcattgtgcgtttcatggtgtacctcattgagaatgttgatcgaaagaaattttgctccagcgcaggcgattggcattgctgaccacggtgatcgaggagagcgccatcgccgctccggcgacaactgggctgagtaaaaatccaaacgctgggtaaagcacacccgctgcgataggaatgcccagcgtgttgtaaataaatgcgccaaacaggttttgcttcatattgcgcagtgtggcttttgacagctcaatcgcgctcaccacactggttggtgatgagttcaaaagggtcatctgtgcgctctcaatggctacatcactgccactgcccatggcaataccaatgtcagccagcgctaaagctggggcatcattaatcccatcgccaatcatggcgactttacggccttgttgttgcaaagcttgaatgtgctgcgctttttggtcgggcagcacttgcgctatcacttgcgagataccgagctctttggcaatcgcattggcaaccgaagtgtgatcgccagtcagcatcacggtatgaattccaagctcattgagcttacgtaccgcttgcgctgaggtgggcttgatcgggtcggcaatcgctaacacgccttgcaacatgccacgataagccaccgccaccggcgtccacgcttgtgctgcaaatttttctagagtcgattcagccatcgacaaatcaatgccttgttcttgcataaaagcgagagagccaaccagcacggtttgattttggtaatcggctaagagtccacgtccacgttggttagtgaattggctgatctctactggactaatattgcgttgtttcgcgtaatcacagatcgctttagccagtgggtgttctgattgctgctcaagggcgtatgctagagccagtaattggttttcatcaccctgcaacacatgcagtgattgaatactcggtttgcctaaggtcagcgtccccgttttatcaaacaccacggtatctacctgacttgcggtctgcagtacgttggcatcgcgaattaaaatccccatctctgctgctttgccgatacctacggtaatcgagagcggagtggcaagccccaaagcacaagggcaggcgatgattaatacagtggtcgcaacgaccaacatgtaactggctttaggatcggggccatacagataccaaagtgcggcagacaagatggcaatgacaacaacaacgggcacgaaaacagaggaaatctgatcggctaaacgagccatcgccggtttactgctttgcgcttgtcttaccatctggataatccgcgccagcatggtttgcgcaccaatgccagtagcggtgatcactaagctgccatcttggttcaatgtgcccgctgcgactttcgcgccggcttctttgagtacaggaatgggttcgcccgtgagcatggactcatccagataagagtgaccagtactgaccacaccatcgacaggcacttgctctccgggtttgatgcgcagtgacatacccagttgaatatcagcgacggcgatggattgatcgccttgttcagtcaccaacgttgcttgctgtggttgtaagttaagcaaggcttgcagtgagcgattagtattgcttttggctttggtttcaatgtaatgacccaatgaaatcaaaccaatgatcattgccgttgcttcgaagtacacatgacgcgctgcatcagggaacgtttgcggccaagctaccacgagcatggagtaaaaccaagcagcgccagtgcccagtgcgactagggtgtccattgtcgctctgccatgagtcagtgcttgccacgcattcataaagaagtggcgtccggcggtgagtagcagtgcgaaacagatggtgccgattcccccccagaccatttgatcactactattgcggatcatcatgttgccgccaaacacgccccacagcattaaaggcgtacccagagcgatacctaataaagcactctgtttatgctctttttgtaaggcttctaattgcgcttgttgtttggcttgctgctgtgctgggtcatccaagatctccgcttggtagccagaactttgaatggcgttaagcagtggttgcggattggcgaaaatgcctctcaccaaggcactttgctctgtgaggttgacttgtgcactctgcactccctcaacagaaagcagggctttttccaccgatgcgacacaactggcgcaggtcatccccttaataagcagagagagtgtttggctagacgcctcagtggcttctgtgttcgaggagttctcagcgtcaggcgtgtcggtttccttctcatcaatggaggctgctggcgcgaatgttgattcttgttctgcttctatagcctgatagcccacttccgccactagcgcttttacttgctcagcggttaaggttgtaaccagtgaaagccgctctttactgacgtgcagtttggcaatctctgcctgcgcgctgaggtgcgtggtcagtttattcacacagcgaccacaatttaaaccttgtagctgataagtttgctcagtaccgccttgataacccagcgattcaatactggtgagcacctcatttaaggtggcatgggtatgcagttcaatcgaggttggcgtcagcgtttcgatctcaacggtgagatcttgattgagttggcgctccaattttcgcgcacagcccatgcagttcaggccacgcagcgctaaagcaaaatggttcatgatcactcctccttgcggaatgtccacaaggataaaccttaaccttaaggtaaggtcaacccttacttctcgaactcattttactgagagtcaatttgccgaaaatcgtgcgtagcatcgcgttaactcgggtgttagaataccgcccaaaatttcgcatgctgagctctcagcaaaagaatctcacaaaggtaattcaaatgacggttaaaactcgttttgcgcctagtccaactgggtatctgcacgttggtggtgcgcgtacagcactctattcttggttatatgctaaaagccaaggtggtgaatttgttctgcgtattgaagacaccgacctagaacgctctactcaggcggcggtggatgccattattgaaggcatgacgtggttaggtttggaatgggatgaaggcccatactaccaaaccaaacgttttgatcgttacaaccaagtgattgatcagctattggcagaaggcaaagcctacaagtgctatgcgccgaaagagctgctggatgaaatccgtgctgagcaagaagccaacaaagagatgcctcgctacgatgcgaatcatccaaaaatcaaagcggtcaatgatgcggcaaaagaaggtgagccttgctgtatccgtttccgtaacccgaaagaggggagcgtcgtttttgatgaccaaatccgtggccgcatcgaaatccgtaacgaccaactggatgatctgatcatccgtcgtactgatggcactccaacctataacttctgtgtagtcgtggatgatgtcgatatgggtatcagccatgtgattcgtggtgaagaccacatcaacaacacgccacgccagatcaacatttacaaagccatgggcgcgaccatcccaacctttgcgcactgtgcaatgatcttgggtgatgatggtgccaagctatctaagcgccatggcgcggtttctgtaatgcaataccgtgatgatggttacctcccagaagcgctgctgaactacttagtgcgtttaggttggggacatggcgaccaagagatcttctcacgcgatgaaatgatcaacttattcagccttaacgcaatttcaaaatcagcgtcagcgtttaacactgacaaactgctgtggttgaacaaccactacatcaagacttcagagcctgagtatgtggcgaaacaccttgagtggcatttcgagaaccaaggcattaacaaagcgaccggccctgctttagcggaagtggtgaagttggtgggtgagcgttgcaataccttggttgagcttgcgcagcaatcacgttacttctacgaagattttgctgagtttgatgctgatgccgcgaagaaacacctgcgtggtgtggcaaaagagccactgatgctagctctgagcaagattgaagcgctgacagaatggaataccgaagcactgcatcacgtgatcgcacaagtgtgtgaagagcttgagattggcatgggtaaaatcggtatgccactgcgtgttgctgtgactggcggtggccaatcgccttctgtggatgcggtgatgaacttgattggtcaagaacgtgtaattgcacgtatcaaaatggcactagagtacatcgaaactcgcgaagcgaatgcatagttgtttgattgcataaaaagccaaagccgcagaacaaactgcggcttttttattatcttttgaagtcttgttctaattctaccgtttatagttaagggtatgtgttttagtcttttctcatttttagcaaagacgtgacaaaataataaccgaaaggctctttttctttttatttcatccgctatagtgatgccgacaaaaaggtgatctggctcgagtacgagttaacctttttgaacggtcgaggatcagcgtataactctcgacaataatcataaagaaaaaaggaaataccatgaaaaagctagcggcaattatttcagcgacgttactttttgcttcttctgcggcagtggcagaggtgtatgtcggaggtaaggtcggtaaatcttggttggatgacgcgtgtctagctggtcaatcttgtgaagatgatgatcaggttgtaggcgcgtttctgggttaccaagcaaacaaatggctctctctggaagcaggctacgactacttaggtaagtttactgctgctggattgaatgatgagaaggtacaagcggtaacgctagcaccaaaactcagcattcctctgaccgaaggcattgcgctgtacggtaaagtgggtggtgcttatgtcgattacggcagcaaggacgactactcatacctaggtgcagcaggcctagagttcaacactaaccacaatgtcactatgcgtttggaataccaaaacctgactgacattaataacgacatcgtacgtgcacgcgcagaaaccgctacactcggtatcgcttataagttcggtggcagtgaagagccagcaccagtggtagaacagcgtccagctgagcctgcacctgttgccgcaccagtcgagaaagtggcagtcactaaaacctttactttccaacatctggatagcagcacctttgctactgcaagtgctgagctaaaaccagcaacggttcagaagctggataaaattgtgggttacctaaaccaatacccacaagcaaaagtagaagtagttggtcacacagactcaacaggttctgaagcttacaaccaaaaactgtctgagcgtcgtgctcaagcagtagcgaaagcactagaagctcaaggtattgatgcatctcgtatttcagctaaaggtctaggcgaaagcagcccaatcgcttctaacgcgacagcagaaggtcgtgagaagaaccgtcgtgttgagctagtgatccctgaattccagtaccaagttactgaataatttacggtaatcatcaagattcaatctacaaaggcccattcgggcctttgttttttctggtgataacaaaaatcgagtgaaaaaggttttatttcaggtcgatactgtttaagcgtcccataaacaccaaaatatctaagcaatctttatgcgcggccaatagggcttttttggttttcgtgtaggcggccagttttccgtgtttattgatggagcagaccacgctgcggaagtggcatttaccttgttcatcgtattctcgccaagccgcaatataacaagcgtctcttgccgtggggttatccaaggtcggcctaggtttatggatgattttgggttctaagctgtgtggtaagcgagtcatcaagtaaggatcttttaggattctgcgccaaaatttgccccacatggcggagcccaattcgttgcgcagcaaaatcgctttcttcaatcctttcttttcaccaagccgtacaaacccgactgagcgatgtaaaaccttatcgtcaggggtatgaatatgaattttatacgcggttttcgctttggatataaagcggtgtccggtattcgtctctaggttacttttcgacatgacgtgttttataaataaaactgttaatagtaataatagaggcttttggctagcacgagaagaaatgtgctgtaggaatgaccaaagattgacatagtaagctttactctgaccttgtatcctcttcctacttgaagcagtagcggtgttggctacgttcgccccccaatcacagtgtttatctatattcatggagatgaactctcttgtcgcctacctgcaactccaagtcgtttgggtatagtgacgctatttacgttttcgcttctctctacttcccctgcaacgctctttctatctaagcaatgtgctcataaatgcaaatgagaatgctttacatttgatttgtgaattattaagattctcaatgatgtacgttctatgcaactcagtgtcttggttaaaccgtggctcagtgcattgttactgtatgttcgtcggaatacttgcaatcaagcgcatggacttgagtcatggtttagcagtgctgttttgttttgccgcgtactttttcgttctggtatttgtcattgaaaacgaaggaagcctctcatctccatactggcctgagcgcagtgtagtggttaatttagagttaaggagaaattcaaatggcagttttatgcccagcgcgagtcagtgttgcagagaacaaaaagtttaaattgcacaccttgtcggcgatgatgatggggcttttcacgggcagttttgcctatgcggaaacgcagaatacgagtaatcaagagcaagaaatgcccgtgttggtcgtgattggcgaaaaaacacaacgcagcatttatgagacgagcgcgagtgtcgaagtgtttgatcaagacacgattgagagaacacccggcgcaacagagattgatgatctcctacaactgatcccaaaccttgtcgattcgggtcaaagcaacaatatgcccacgattcgaggtatcgatggctcggggccttccgttgggggcttggccagttttgctggcacatcacctcgcttaaatatgtcgattgacggtcgttcgctgacttattctgaaattgcttttggccctcgttcactctgggatatgcagcaagtggagatctatttagggccacagagctacattcaagggcgaaatacctcggcgggcgcgattgtgatgaagtctaacgaccctactcatcattttgaaagtgcggtaaaagcaggtattggcgaaagcgattattcgcaaacagcgggtatgatctctgcacctattattcaagatgagttggcatttcgtttgagttttgatcagcagaagcgggatagttttgtcgatcttgctgcttttgaacccgcgggcgatcctaaaaaaatcgagatgaattcggtgcgcggtaagctgctgtacgaaccttccgcactggatggttttaaaaccacgttaacgctctctcatatggattctcgtgggccacaaacagaaaacattaatgtggcgggtaacgaagccttccgaccggtttatgagacagcctcgttcacgacggcgtgggatattatctggcatctcaacgacctcttcacttttgaaaacaatctggtgtatgccgatttcagctatgaccgttataccaatcccaatagccgaggggatttcaataccgatggtaaagaattccatatcgaaccgttattacgctatatcgcactggatggtagcgtgaatacgctgattggggcgcgttactaccaatcttcacaggatgatatgtacattgatgcggccagtgcatatccgatggatggtcgcactaaagccaaatccgtttttgcggaagtcacttatgcgttaacgccttctatcaatgtgaatttggctggccgatttgaaagagagcaggttaagcgaaacgtctcgcacccaagatacaagcttgattacgatgaaacatccagcgtatttttgcctaagctcgatgtggcatatacaccagtgcaagggcagacctatgggattaaagcggctaaaggttacaatgcgagtggggcaggactagcctttaactcgatgcaatttacaggttttaggccctacgagtttgaacaggaatcgatttggaactatgagttttacacccgtcaccgtttcagccattctgtcgaagtgttgactaaccttttctataacgattttgacagtatgcagatgacgcaaaccacatccagtggtgatgtgtttatcgctaaccttgatgaagcgagcacttacggcgctgaaatcggatcacgttggtatgcgacctcttcactcgaactttttgccaacctagggcttttgaaaaccgagttcaaagaaaccaccggaaacaccaaagagctgcctcgagcaccgaaaatgtcagccaatgttggtctgctttatgattttggccaagggtttgagttcagtagtaatgcggcttataccggaagctatttctcggagagtggcaattcagaaaaatttgcgattgactcatattgggttgccaatgctcagttagcctatgtttttgagcatggacgagcaaccttgtatgccactaacttattggattctgataaaacaacgctttatctctcaaccaataatacgcttgaccaacttaaacagcagcctcgcatgattggtgcatcggtgcagttgaatttctaaatgatatttcaaatggactgaaacaaaacaacgcctctaagtcagctgagaggcgtttttttatgttcgcatttaagtcttgagctgagctctcgaggttaaaccatatcctaagaatctgggctcccttggttaagttgatcgacagttgtgtaaaattggttaatgatatacattctcatttgaattgattgtttacagggccgaaccattgtttttcaactggggcagaacgttgggaggattgagtgaatgacactcccagcaaggttggctaaggcataagataaattaggtgaaagaatgagtaacgaagtcgagcgcgtttatccgagattactggattttgtgcgtaaaaaatatgtatcaaaaaacctacttcgagtgacactgactggtgaggatttaattggattccccgaagatcaaaatgggtcacacattaaggtttttttccctaatcaggcgagtggcatactccaattaccgattcgtgagggtgataaagtcatttggccagagcataaaccggttccgcgagcgtataccgttagacaataccgagcacagagcaatgagcttgatatcgattttgttgtgcatggagaaggaacaccgggtggtggatgggcgctaaaagctcaaactggttcacaactcggtttgataggtcccggtgggccagaccctcttattgagccagcagattggcatattatggctggcgatctctctgctgtgcctgcgatcagtgccattttagaaaaaatgcctagtcaggccaaaggttatgtatttcttgaagtggatgatatcgaagataagcatgatatctcccatccagaacagatggtgattaagtggttagtgcgcgatcctaatcaggcgcaacccgttttggcgatggcgattgaacaactgccagtaccgcaaggcgcagagtcgctttctgcttttgtggcaggagaaaatgagagcgttattgcgtgtcgtaaaattttgcgcaatgaatatcgaatcgcaagagataagatttacgccattccttattggaagcgcggtaaaaacgaagaggcgtaccacgaagagcgccatgtggtgatggatgaagagttttaacctctgactcagcacggatttcattcaccttgcctgttaatgtggtaagccccatcaggggcttaccaacccctctcttttcccttcctacaaagcttctgatgtgttggctgcgttcgtgactttttcaatctcgaggctgaccgatttcgctctttacatgtaattgataatgattattattaactaaaatttacacattaatgcgttgcaagacgatgtgtaccgagtaaagggatgaatctgtgggtttaaagatgaaagaaatgacagcaatgcaagcggcttattggctagggcgtcaacacgactgcttgctcgatggtgtggccgcgcatctctacgccgaatttgatggtcaagcattaaatcgacaggcgctaacggaagcggtacgtgcgctgtacgcgaaacatcccatgttacgtttagcgatcaccaaggatggacagcagaagatcttgccgctctcaactttccatcagcttaaagtggatgacctatcacaatggaagccagatgaggtggagtcttttgtgcatactaagcgccagcgaatgacccaccagatgctcgatttaactcagggaaacccgattgagatcagcttgactctgttgcctgagggcaaacaccgattacacattgatgcggatatgattgcgtgtgatgcacaaagttttcggctgttggtggacgatctcacctcactctatttagaggccatagagcatcgattagagatcattgagtctgatgtggtgacttttttccaatatcttgatgctcagcaagccgatcgtgctttggcaaaacgcaaagaggtggataagaaatggtggcaagagcgtcttgcgacgattcccgccgagccaagtttgccttatcaacccgtaccaaccgacgccgttagcgcaaacagccaaaggtttgcacactggttcactccagtggagcgcaaagggttggcggaggttgcgcggcaacatcatctcacactgacccaactgacattggcactcttttcacaagtgattgccaatgcttgccaagagagacaatttcgactcaatgtacctacattccatcgcggcaatcgctctttggatattgaacacacgatcggcgatttttccaatttgctgatttttagcgccgatgtgggaacgactcagaccctgttaagcctgtgtcagcaaacggctaaccaactgcatcaattacttcgccatgaaagctattcaggggttagcgtgatgcgcgatttatcgcggaaacagggtggggtgcagcgttcaccgatagtctttacctcaggcatggaaatgcgagacgaggagatcttttccgatcatgtcactcagcatttagggcgtatgaattgggtgatttcgcagggagcgcaggtgactctcgatgcgcaaattgctccggcttatgaagggattttgctcaattgggatgtgcgaatggaaaacttcgctgataaggacatcacagcgcttttcgcgcattacgttgatttgatccgctgtgtggcgctgcatcctgagatgatgcagcaaagcgtacaacagattgacgcgcaactcggttatgctcgccgcgagtcgattcaggagatgccactgacccctttacaacaagcttacttgctaggtcgctcaacccaaattgccttaggcggcgtcgcgatgcatgagtttcgtgagtatcgaggtcacatcgacactcagtcactgcatagccgtctgctctatctcgttgagcatattcctgccttgagaactcgcattgatcaagagaaatggattcagtgggtctctccttgcatagcgttaaattggcaagccatcgatttacagcatctttcccgcgaacaagccttattagcggttgagccagtcaggcagcaatatcagcagcggatgcatgatttaacgcgctcgccctggcaaatctgtgtggtgcaactgccaatagaagagcaagaggagttcagctccatcgtattgaccagctttgatgctttgattgtcgatggtcgcacccatgcactcattcttgctgcactactaggaagcgaagaacccgatataactcaggtggtgcaaaatgctcgtgatactcagtccatctcgccgcaattcgcctccaaaaaagcgcaagatgaagcgtattggaaaagcaaacttcatcctgattgcccgccgccagcactgccttggaaacaagcattagagacgatcactacgtctcgttatgctcgtgaaagtttgcaaatacccaaagagagtgtcggtaagctcaatcgatgcggcattgaaaatggcttatttctcaattccttgctgacagcaaccatcttggacgtgctctcctattggacaaccgaaatcgggatgcgagtgggttttccggtattaattccaagcagtaatgcgattgatggcaatgagtcatcctttgtgatcttagagcatgaaaaatccaccctgagtttgctgagccaagcgagcaagctacagcgtgagatgctagaggctcttgagcatcttgctttttctggcgtcgatcttaaccgtctgttgatgaatcaagcgccgcaagctctggtgctgccggttgtgttaaccaatggtttgtcttggaaaaccctgaatccagaggacgctgtcactctgttcgatggggtaacgcaaactccgcaggtggctttagatattcgcttaacttacgacgagcagaaaaacctcatcatcagctttgattatgctttagcggttttagagactgagcttatccgcgagatgttaagtgccttacatcatcgcttgagtcagatcacttcgtcagcatcattggccgcgccgcttgagccatgtatcgacctttcacactaccgttttaatagcgatgagtcggccagtcacgattgcgattttcttgccaagttagcgcagcaattgtttgtccgcacagaggataaaaccgctgtgatctgcggtgaacaaaccctttcttatgctcaattgggtgagcaggttcagcgcgtgatgtggcagctcaaagcgcgagggttgaccacaggaaatgtgctcgccatttgcttgccacgcagtgttgaacatatcgtcatcagtttggcttctgcactttcggggattatctgggtacctattgatgctgcgtctcccaaagagcgtctgaattaccttttagaaaattgtcacgccgatctggtggtgatggataagccctgtgagtttggcaatgtgatcgcttttgatgccttgattgagcctgtcttattcgccgatggagtacctgacgttacaccactcgatcaattaagccgattaagccaaagccaacaaacggcttattatctttatacctctggcactacgggcaaacctaagtgcgtggtggtcaataatcaggcgacctcgaatgtgattggtcaaactggccaagcgtggcatctcaccagtgaggatgtggtgatgtcagtgacgccattgcatcatgatatgtcggtgtttgatctctttgccaccttgagcttcggagcgacgttagttcttcccgctgggcatgaagaaaaagatgcgttgcaatggaatcgcttaattgagcggcatcaagtgacgatttgggtctccgtccccgctatcttggagatgttgctctcttgcactcaagcagggcaattacactcacttcgtctgattgcccaagggggggattacatcaaacctgccaccatcgcccaattacgcgctggttcaaatccgccgcggttgatctctttgggcggtcctaccgagacgacgatttggagcatctggcatgagctgacggcagatgatgtcagcgtgatcccatatggtcggccgttggcgggaaaccgttatttcattatggatgagatacaacgccatgtaccgcaaggtgtggtcggccgtatcttcacctctggggtcaatttagcgcaaggttatcttgaagacggcgaactgaaacaaaccgattttgtcaccgtattggatgagcatggccaccctgtgcgcgcgtttcgaacgggcgatcaaggctactaccgcgcggacggcaatatcatttttgctagccgcatcaatggttatgtgaaagttcgtggggtacgagtgtcactgccggatatcgaaaagcagctgcaaactcatccggcgctcgcgagcgtggtggtggtcgattatgcggatactaatggagataccgctttagccgcattatttagcgttaaacctcagcaatcagcatcgagtcaggcgttacgagagtttgccaaacaatcgctaccgtcttcgcatattccgagtcggtttattgctttagaggctttaccgctttctgcgaatggtaaagtggatcgcaaacagtgccaagcgcatgttcagcgacaatcgatctctgttgaaccagtaggtcaaccgaatcaaagtcaacctctctcaccacctaccttgtcatcggcttccttgagtgagtttgaacagcgagtctggcgacagcatcaacgacatggtgacggacgcaatcaatatgcgaccgcttatcgattgagcggaaaagtgaatatcgcgcgcttaatcacagcgctcagtcagttgcccaatcattttccagtgttaaaccgacgctatgtgcttgatgaggcatccggcttaaccttgtactcggcgaagccaacaccgcttgagatccattttgagcatgttgagtcaatggatgaggcgtttgaacatcttgtgcgatggcaaaatcagccgatggatttagccaagcaagccacactaagtttttgcttgttgagtttggggagcgaagagcgagtgcttggggtgataagccatcaaattatcagcgagcaatgggattggcggcgcgtatttgagtgcgtaaccaatgggtataaccaaatcgcctgtgacatcgatcctgtgatggagggggaggatctttccctcggctttacccctgtgatgccgcaaacgccattatcccaagcgttgttgccgtggttacagcctgcgagccacgctacatggattgagcagagcttgccgagcgcaaatagcgccatcaatacgctttgcagtcgtaaatatcggattgccctacacagcagcgtactggcggagcatggtttagcgcagccggataagcaggaagtgcttgcactgatcgccgcgttatttgctcgctaccttgccgcaagtgcgaaacttggccaatttgagctttacgttccgcatgatgtggagcgcaaaacgcgtgagttgaatggttctatgattgaaagccagttggtgcatatcgcccttaaaggctttgagcgtccgctttcgcaactgagccaagagatcttagacgctatgcgccagccgttaacggggggagtcgctagcgaaactcacgcctctgccgcagccttggtgacttggttagtggatccttcagtgcatctacaattggagggcttgcgctgcgaaaaattactttttgcagccatgcaccccaaatttgaagtcgccttgggggttgggcttaattgccaaggtgccctagtacttgagctggcgttagatgccacggtttccccccatgtcggagcctacttgcttgagcaatttgtcgctgcgataggtgggcgaacaatgccttcttcgacaacctcatcctctcatgtctcagccattgagttgacgtcaaacaatccgccgacctcaaacaatgcgcatgcggcgttggcagagtctgagcttgaattgagcgctgtaaattcctctgcggttgaagagtgcattttggctgagtttcgctcagcacttggtgttgccgagatgacggcagaggatgatttctttgattttggcggacattccctgatcgcaacgcgagtcattggtcgcttgttgagcgagcaaggtattgaactgcacatcaatgatatgtttagtttccctaatgccaagcaactggcgcagcaagccgtacttcaccgtaaacccaccagcacatcattcgcagtgagtgaggtggtcgagtcgtccaaagcgcctttgtcgttagcacaagcctctttatggaaggcgatgagcaaatacgccaagtttggtttgacccacatcttcaatcttccgtttgcgcttaaatttttagatgaggtcaatgagcaagcatttggtgaggcttttcactggcttttactgcgtcatgctgggttacgaacccactttggcctagaagatgggcagccttaccagcacgtgatcgcagccagcaacatagaacattaccagtggttctggacgtctaaagataacgccgcccaatccgtggccagactactggcgcaagaggccgagcacacctttgacctgagccaagaattgccacttcgactcaatttcgtacgtgatgaacagacggggacgcaatatctttcacttctgttccaccatattgtgttggatgagtggtcgatcaatattttgatggatgaattagcacaggtgtatcaacacagtgtgcaaggtactcgtccacagtggcaaacggaacccttacctttccatgagtttgctcgcaagcagcgttcttcggcattcaatcaaacgcatcttaactattggttaaccaagtttgccggtgtgccttgggcacagcctctgtttgctgcggatcatcctttaagtaacagcactggcgtcgatcttggagaaggcggctgggtcgaaataaaattgccgaaatcaaccatggtatcgctgtatcaattggctaaagcacgccatgcttcgttgtttaacgtgatgtatgcggcgatttctgcgtcggtacattgtctcggcgcaccagaaaagctgctggttggcacacctgcttccggtcggctggatgccgagtttttcgacacagtcggttatttcactaccatgggcgttcagttggtggatttcacgaaagtacaaacggtgtggcaactcatcgagcaagtgaaaaacagcattaaccagtcgatgccatacacagatattccgattgacctgattgaagaagggctcaaaggtgttgagcatgagacggaaggtcacatgtttgaggtctttatacaactgcatgcaaaaaataagctgcatggagagctactgttgacagaagggcatgcgatccgcttccaacaagtcgatcccgataaaagtgaatccggcttaggtttacagtttgaaattttagaagagaggatcgagcaaaagcagacgttgagagtcatgatgagttatatgtcgaaacactatagcccagctcaagtcgctctgttgaccaaggtaaccagtggcatgtttgagcggttttccgattgtattgcacaagatattgcactgccgacgctgaaaaagcaggtgaggcagcttgaagatgaagcttgtcgctctccgtccatggggtagtgtttttgtgtcgtgactcgatatcgtagtggtagggaatagggggcgaagggcgatattggctccccctttatgacaagccctgaagtgccagtcgtggcagttcagggcttgaacttgatgattgagctacatctgcttgtgcatcacatcgccgatttgaatactgtaggcgagctcaggttgatccacggttaattccgcttcgtgttcatatacacgagacacggtaagcgtaatctcactttgtgtgactttgttacgcggcaacccttgttggtcgataaaggctccggtgtgccagaggctgagcttgtcaccttgtttaacaccgtgaatacgaccgagatccatggtggctgtggttccaaatttcgccacaatttgcggtaacgtgatcttacaagaaatttccgattcaaggtcgagcataatgttgcggctcacccgcagcatcatttcaccataagtcgatgcccagaaacgtgcactacgcgtatcaatttggctggttttaggaaacggccagcgcgcaacttcacggtaagtgcgtgtcatcacttcattgcctgtttttccatcaaacacactgatttccatcgcaaactggcgattgatgatgtcatcttgcagcgttttttgctctatggtggcggttaaatcagtgatcatgccgcccatgatgtactgcgctccagcatcttgcgcgatcatcttgatccgctccggcgctttagggtcaatatcgtattgggttgtgccgaccgagacaaagctgcgagattcttgctctaagcgacgattaatcacctgcgcaaaatcatcaccgacctgatagatctgtcccatcactgcttgctgaggtgaggccagatcaatattgccgatcaacatggtttttttgtattgctcaacgtggcaagccgttgccgatgggtaaatatcaatgcgggtgcgcacgtacatcacattgttaatcgctttgcgttcttcaatcaggatgtagcgtacctcatggttagcaaacaggtattctcgacgatcagactccaagagcggcatcaaattgctaatgctgccaatatctgccccggcaaaatttaccgctttatacagcgcatcttctaaggcgtgtaagcgggcgacctcttcggaagaaacaatagcggcagagcctgtcacttcataccaagctgcatgagccgatggaagttgaagcatcatccaaagtgctgaaatgatagataaaatattttttttcatcgtaaggtcccaagtgggtataaattttgcttttcaaatcctaactgatgtaggcattgcaattctgaatcaataaccgtttaagaaaagcaaggagcgttccagtttaatcgagtgagaagctgaaatgcgcgccatagtatatctggagatgaagagaatgaaaaaatggctttccttagtacccgtcgttttactgacttcgtgtgcatacgccccgatttataacggcaaagagccatacaatggttcacagtttatgttgatggagagtcctcgtcacacattggatttctttgttgagagcatgacggaagatttgatgctctcgaataccagcattactgctcgtacgccaattgcggtgacctcgtttgtcgatctgcaaaatatggataccactaactggctcggtaattcggtctcggaaggattcattcaccagtttcagcgccgtggattcaaagtggtggattttaaaaccacaggttcaatccaagtgacgcagcagggggattttgcctttagccgcgactggaaaaacctttcttcagagcaagaagtccagtacgtactgacagggactatgctgcgccaagaaggcggggtgatagtgaatgctcgtgtagttggcatgcactcacgaattgttgtggccacggcacaaggtttcttgcctgccgatcgtatcggccgagatttggatacgctcaacagtatccgtacccaagatggagtgttgatccgctcagatccaaccatcactcagccgtacaccgtgattttacgtccataggagaacgatgatgaaatctagcttactactcctagtggcagccttaatgatgacgggatgccaacccttgcaaagcatgcgccctgatgattggttaacggcggttggctatgccaatatcagcgagcagagagggcgtgatgaggccgagaagcaagtgcgtgcgatgcgtgcttctaaaattgatgcttaccgcgagcttgctgagcaggtgtatggtatgcgcatcagtggtcgtgctgagttacaagatcaacgtcttggtacagagttgacggcaggtgcggtcgatggtgtgattcgcggtgctgaagtggtacgcagttataaggttggggacagctatgtcactgaactgagacttgatattcgcaagatggacaagatgcgtgattacggggaagttcaacaagttcccgaaaaacgacaaatgaccctattctagcgctcacctcttcatctcccagaacgtcaaaagcggcaatgattgccgcttttttgcttgttaagtcttactgatttgtttgagtgcttcgctttaagagactctctcatcatgctttgatattggtacccaaggttgaaatagtatgggttttcccggtcgcgctgtaagtcataccaatcttgccatgactttgttgcatcaggttattgagtttattgaagctcaattgcgcgcgggccaaagcatcgccattaatcaggttggcttgctggcaatccatgataatactgcggatttgactcaccaactcattgagataagtatcttcagtcaggctcgcgacatgcggatgtttcgcaatgcgttggtcagtttgctgtaattgattgactaaggtgagtttctgtttagcaatggattcgatatcgacagagattcggctggtgatcgcaactttctccgcttcgagtacggtcacgagttcttgcgcatttttcagttgaaactcaaccaagtcttttaatgctgccatcgccaaatcgcctatacattacagtgggatcatcattctttgttcgtcactttttcgttataacaacatactcgtcggtgacgcacgctggggacacgttaggttagaagccgcccagttctttttcgaatttgatcatattatcggccagtttttcagggtcaaccacgtaagagccgttagcaatcgcttctttgattgcggcgacttttgcgctgtcaaaactgggtcttgaagccatttcactatgcatttcgccaatggctttactttgtgagctcagcgataccgcatcttgaccacttgccgatgagcgcgataccgccccggattgagtggaagagttgctggcatcagaagaacgcacattggtgcggctggtcgtgtttaacgactgtcctgcgcgtatgttatcaatacctgccataaatgagccttttcaataaactttaacgtgtactgtcaatatcgaccacacaggtcgaaactttagcgacttttttaaccaaacagaaaatcacttggcaccagtttttctgataagcaaggtagagctatcaaaacgcgacggtgacctcaccaacaccactgacttgcgcatcaattatacggttagatttgtcatttttcacttttatctgctctcccacgacaccatcggacatcgccgtccctttggttgtgatcgacataccagattttcccgctcggatgacaacactttcatttcgacacacgatgcacacatcgttctgttcaatcacatcacccacacgaatattttttttgatttttgcaccaatcacgttttcaggagtggaaaaaccttgccgccggaaacgcagcaggtctaccatacttaacgtaacatcttgtgcggaaatcatttgtccccgacttaatggggttgccgcagtgatgagtgggatagtgatcgtcagacgaaccggcacataaacacgccagttatccggtttacactccaccaatacggtgatgttggccgcagaaccattgctggatgatgaatttgttgtgagaggttccggacaatcggtcgcgaatagacgatcgtctatattggcagcattgaccactaactcaccgccagcaggcatatccaccgtgctcagcacatgattttcggcggcttctttgatcattgaaagctgttccggcgtggctgcattggccgctagactaaagaaaaataataaaaagccgataaagctataaaatatttcacagaaagctctacacttagttatgaaatgcgaatggagatcgatcttcggatgcatttttcgtttctctggtttcttcatagcctgtagtagactatcactttttttggataaaagtttgagatggagatgagcttatgacgggtattcttgattctgtgaatcagcgtacgcaactcgtcggtcaaaaccgattagaactattaactttccgtcttaacggccgtcaacgatacggtattaacgttttcaaagttaaagaagtcctgcaatgtcctaaattgacctcaatgcctaatttgcaccgcttagtaaaaggggttgcccatattcgtggtcaaacggtctctgtgattgacatgagccttgccgttggtggtcgtccgacgacggacgtggataaaagtttcgtggtcatcgcggaatttaaccgtactattcaagcatttctggtgagctcggttgagcgtatcattaacatgcgttgggaagcgatattaccgcctccgaatgggactgggaaaagtaactatttgacggctgtgaccaatattgataatgaattggttgagatcatcgacgttgaaaagatcttggctgaaatcacgccagttaacgaagatatggacagctcaattggtgaacaaatagcccaagttgagcaggaaaaagagtttgttcgtcgcattttgattgcggacgactccagcgtggcacgcaaacaggtgcaacgcgccattgagtctatcggttttgaagtcgttaccacgaaagatggtaaagatgcttacgaaaaattactggaaatgctcagtgaagggccaatcagtaatcaaatatctttggttatctccgatattgaaatgccagagatggatggctataccttgactgcggaaatccgtcgtcataacgagctcaaagatctttatgttattttgcactcttcattgagtggcgtgttcaaccaagccatggttgagagagttggggcaaatgcgtttattgcgaaatttaaccctgatgagcttggtaatgcggtgaaagctgcgctagttaaataaagagaattgaatgactgctataacgattagcgaccaagagtatcgcgacttttgccgatttctggaatctcagtgcggaattgtactgggtgacagcaagcagtatttggtgcgaagtcgtctaagtccactcgtcaccaaattcaagttaagttcgttgtctgacttgttgcgggatgtcgtgacaggacgaaatcgcgatctgcgcgtagcagcggttgacgccatgacaaccaacgaaaccttatggtttcgagattcctacccatttacggttttagctgacaaattattgccagaaatggcggcaaataaacggccgataaaaatctggtcggcggccagttcatcaggccaagagccgtactccatggcgatgacgattttagaagtgcagcaaaaacgtccgggattgttgccaagcgtgtcaattactgccacggatatttcagccagtatgttagatatgtgccgagccgggatttatgacaacttagctttaggacgtggtttatctcctgagcgtcgtcgagtgtttttcgaagatgctggggatggccggatgaaggtgaaggataacgtaaaacgtttagtgaacttccgtccgcaaaacttaatggaaagttactccttgctgggtaagtttgacatcattttttgccgtaacgtgctgatctatttctcgccagatatgaaatctaaagtgcttaatcagatggcggcaagtttgaaccccggcggctatttactgttaggggcatccgaatccctgactgggctgacggataagtttgaaatggtgcgttgtaaccctggtatcatctataaactcaaataaagaaattaatccatctcattttgcccggtttctaccgggctttttcttttctttcagactctaatgaacaggaacgcctttttcttgcaaggagtcggtttggcgtggagtttgctaaatattatccatcttgctgctaatcgttccagttttgaaagttggtacgctaattgcaaataatttcagcagtaacggtcagttcttatcgaagaggtaaacatggctatttcttttgacagagccctaggtattcaccaacacacggtgggcgtacgtgagcgcaactctgaggtgattgccaccaatattgcgcaggccaatacgccgggatttaaggcaaaaggaatggacttccagaaggcattgcaagcggcaagttcgggggcaagcattagtcttagccgtaccgatagtcggcatattcctgcctcttcaacgatgagtggggaaattctttaccgcgtaccgacacagccggataccggtgatggcaatacggtggatgtagacttggagcgtaacttgtttatgcaaaaccaaatccgtcaccaagcgtcactggattttctaggcagtaaatttaagaacttaaccaagtcgcttaaaggggagtagatagatgagcttattcagcgtatttaatgtcacaggttctgcgatgagcgccgagtcggttcgtctcaatacgacctcaagtaatctggccaatgctgatagtattagtagttcagcgaaagatacttacaaagctcgtcatgcagtatttggcgcagagttgagtaaagcgcgtttcaaccgcgatcccaatgtgccggtgaaggttttggggattgtggaaagtgataaaccgctggtcgctgaatttaatccagaacatccacttgccaatgatgaaggctatatctacaagtccaacgtcaatgtgatggaagagatggccaatatgatttctgcctctcgttcttatcaaaccaacgtgcaggtggcggatgccagtaaacagatgctgctgcgtacgctgcagatgggtcaataaggataaggagttaacgtatggccggagtcaataatgttggtcaaagcggcttgtcctatattgatcagcttaaagctcttcaagagcagaaaaagccggatgaaaccacagggcagaaatccctgaaacaagaagactttctttctttgctgaccaagcagttagcacagcaagatccgttcaaacccgtgagtaacgatcagatgattgcgcagatggcttcatttgcgaccgttgatggcattggcaagatgaacactcagtttgagagtctcaactcatcaatgacctctaaccaagcgctgcaagcgtcatcactggtagggcgtgacgtgctagtgccgggggcggcaggaatgaaaaagcctgatggcggtatggcggcaatggtgaaactgccgcagtcgatcgataacttgttcatccgtattgagaatgaagctggtcaattggtacgaacctttgacgtcggtgccaaatcttctggtgataaccgcgttgaatgggatggaaaagatcagaacggtaatccgttgccgggtggcaaatacaaagtgaaagcgtctggcttgctggatggagagagtaaagagtttgaagtctccacgtatgcgaacgtcaacagcgttttgttaggcaaaggcgatggtaacgtactactcaatctggctggttttgatgcaccagttcgacttgctgaagtacttgaagtaggcaaagcgtgatagcgctagctagataggagaattactcatgtcatatgtctctcttagtggtttatccgccgcgcagatggatttaaataccaccagtaacaacattgcgaacgccaatacgtttggttttaaagagtcgcgtgccgaatttggtgatgtgtattccacctcactctttactaacgcgaagacgacaccagggcaaggtgtgcaagcggccaaagtggcacagcagttccacgaaggttctagcatctataccaataacccactggatttgcgtatcgcgggtacgggcttcttcgctgtcgcgaaagatcgcttagttccacagcaaaatgagctgactcgtaacggcgcattccacttggataaaaatagcttcatggtcacagcgaatgatgagttcctgctgggttatgaagtaaaccctgatacgggtgatgtcttatcttatgagcctaagccaattaatattccgccgcagttcggtaaaccgaaacagaccgcgaatattgacttaggagcaaacttgcctgctaacggtgatctcaaagaccctgcgctgtttgatattaccgatcctgagacttataaccgtacgacctcatcgaccatttacgattctatggggcaaccttataagttaacgacgtattacttgaaagatatgaatcaagctaatacatggcagacctactacaccgtcactgacaaaaccggtgaaaagccgattaacgttgtcggtggtgatgcggcaagcccaacaggccacgtgggacataccatgcgttttaacaacgatggtaccttgtcaagcttaaacaacggtcaaccaattgtgactgagccactgggtggcggtgccaatccagtcgatctgaacggtgcggatgttaaccaaaccttgtcgtttagcttggattctgccacgcagtttgccgcaccttttgagttgaccaagtttgatcaagatggtgcgacgacaggcttcctgacgaagatcgactttgatgaaaatggtagcgtactggctacttactcaaacggcattaacaccactctaggccgtgttgcgctggtgcgtgttgcgaacgagcaaggactggacaaaaaaggtggtactcagtgggatgctactcagttctcgggcgcgaaaatctggggtgaatcgaataaaggttcgtttgggtcgatcagtaatggttcattagagcagtcgaacatcgatatgacgcaagagctggtggatttgatttccgctcagcgtaacttccaagccaactcacgtgctttagaagtacacaacggtctgcaacaaaatatcctgcagattcgttaatcctcttcaaccccattaagcggcggcaatgcggcttaatggggttgcctctttgcccccttgccgcggcaaatacgcttatctccttcagatttctcatctatcagtttgttccataaggaataattaagttggcatgctgcttgctttaactgctctaactaacgatttgggagcagattatggaccgcgcattgtttcttgccatgagtggcgcaaaacaaaacatgcaagcgatgcagttacgggcaaacaacttagctaacgtcagcacgacgggatttcgtgccgatttagcgcaagctcgttctatgcaggcttacggtgaagggctcccaagtcgcgtcttcagtatgactgagcgtccggggcataactttgcccaaggcagtgtgatcacgacaggccgcgatctcgatatcacgattcaaggtgatggctggatttctgtgctggataaaactggcaaagagggactgactcgtaacggcaacttacgaatcgatgaaacgggactgctgcttaacggcaatgggcatccggttttaggcgaaacaggggctccgattaccttgcctgtgccgctaaacaaagtcgaaatcggcggtgatggtaccatctctgttcgtccgcagggtgccccggctgatgcgatggaagtggtggatcgaatcaagctggttcgcctcaatgaccagtcactgtttaaagacgtgaatggtttatttcgcgctaccgatcccaacactcagtttgaggccgacgccagcgtaaaaattctcacgggtgcccttgaagggagcaatgtgaatgcgataggtgaaatgaccagccttatcgacttgcaacgtcagttcgaaatgcaagtcaagatgatgagcacagcggaagagatggacaaagcttccgattcactgcttcgcagtagctaatttaaggtaggagttaggtatgcaaccagcactatgggtcagtaagaccggcttagatgcccaacaaaccaacattgcaacgatttccaacaaccttgccaacgcctcaaccattggctttaaaaaagggcgggcggtgtttgaagatctgttttaccaaaacattaaccagccgggagcacaatcctcgcaaaacactcgtttgccgagtggtttgatgttaggcgcgggctctaaggtcgtggcaacccaaaaggtacacacgaacggtaacgtacaaacgacctccaacagtttggacatgatgattgaaggcgacggttttttccaaattctgatgccagatggcaacattgcctatagccgaaatggtcagttcaccttggatgatgaaggcgcgattgtgacctctggtgcgggctaccgtttacaacctgaaatcatcattcccgaagacgctatttccatcacgattggtaatgatggtgaagtgtcggttcgtgtccgtggtcagcaggataaccaagtactggggcagatcactacggttgatttcattaaccccggcggtttagagccggttggacaaaacctttacctaccaaccggagccagtggtgagccacaagaaggggttccgggcttggatggtttgggggatattcgccaatctatgctcgaaacctcgaacgtgaatgtgacggaagagttggtcaacatgattgaagcgcagcgtgtgtacgagatgaactctaaagttatctccgccgtcgataagatgatgagcttcgttaaccaacaactgtaattgctaactaagagatggccgcgatgaaacgtctacttgcttctagcttattgattctgctctcaggttgtagcttgatgcagccaccgattgaatctgctgaaaccattcaaggtaccacgacggtggatgcggttgagggggacaaatctgagagtaactcgggtttgaccgatgcgctgcgcaatcgtaccgaccccgttgcgggcgatcccgcatgggcacctattcatccgaaaggtaagcctgagcattacgcggcggaaacgggctcgctgtttaatttggcgagcagcagtagcatgtatgacgattctaaaccgcgtggtgtgggtgacatcattaccgtgactctcaatgaaagcaccaaagcagccaaaagtgcggatgcggatctgaacaagaaaaatgatgcttcgatggatccgctggcggtcggcggcaaagatttgaccatcggggattacaatttctcttacgcactgaaaaacgacaataagttttcagggagcgcggcggctaaccaaagtaacagcatgtcaggctcgattacggtagaagtgattgaagtgttagcgaacggtaacttagtgatccgcggtgaaaaatggctcactctgaacacgggtgatgagtacattcgtctcagtggcaccatccgtccggatgatatcgacttcgacaatacgattgcttctaaccgtatttccaatgcgcgaattcaatattctggcactggaaccaaccaagatatgcaagaacccggattcttggcacgattttttaatgtctctttataagtcgagccgctgggctagtttattgacagcatagtgaacggtgaggccctttggcctcattgttgttttagagagtaaggtacatccgccatgagaaaattcacgattttattgatgttgctgctggcttccagtgcgcaagctgcacggatcaaagatgttgcgcaggttgcgggcgttcgtaacaaccaattggtcggatacggcttggtcactggtttgccggggactggcgagtcgacaccttttactgatcaaagctttaacgccatgctgcaaagtttcggcattcaattgcctcccggcaccaagccaaaaaccaaaaacgttgccgccgtgatcgtcactgccgatctgcccgcgttttctaagcaaggtcaaaccatcgatatcactgtctcttcaattggatcggcaaaaagtttgcgtggcggtaccttgatgcaaactttcctgaaaggtttggatgggcaagtttacgcggtggcacaaggtaacttagtggtgagtggttttagtgcaaccggtgcggatggttcaaaaattgttggtaacaacccgactgtgggcatgatttccagtggcgcgattgttgagcgtgaagtgcctaacccatttggccgtggtgattacattacgtttaacctgtttgaatctgatttcacgacagcacagcgtttagccgatgcagtgaaccagttcttgggcccccaaatggcttcggcggtggatgcggcctcaatcaaggtacgtgctccgcgcgatctcagccagcgtgttgccttcctctctgcaattgagaaccttgaattcaatcctgcagacagtgcggcgaaaattatcgttaactcacgtacgggcaccatagtggttgggcagaatgtacgcctcaaaccagccgcggtcactcacggtgggatgacggtagcgatcaaagaaaacttaaacgtcagccagcctaatgcactgggtggcggtcagacggtggtcgtgccaaacacagaaatagaagtcactgaaaaacagggcaaaatgtttaagttagagccgggggtcactttagatgatctggtgcgtgcggttaacgaagtgggtgctgccccttccgatttaatggcgattttgcaagcgctgaaacaagcgggcgcgattgaaggccaactgatcattatttaaggagccagccatgattaataattccaatgacattggctttatccaagatatcgccggactcgacaagttacgccaaaaggcggtgaatggtgatgaaaatgccggacagtctgcgctaaccgcagcggctcgtcagtttgaatcgatcttcacttccatgatgctcaaatccatgcgtgatgcgaatagtgactttaaatccgatctgatgagtagccagaatgaagatctttatcgccagatgctggatgaacagatggcgagtgagttcagttcatctggttcgcttggcttggccgatatgatcgttgcccagctttcgaccggacaaacggcgagcgagcaaaaaggggaggatggcttccaagaagccatgcgccgtgtggaacatgcacgtaaaacggccagtgaacgcagcaatgaagacttggtggcggcggtgtatccgctgcgtaaaacacaagcggttcaatcgacgcagtttgattctcgccattcgtttgttactaagctcaaaccttatgcggataaagcggcacgcatgctcggggtcgattcttccttgttgattgctcaagcggcactggaaacaggctgggggcaaaaaatggtcaaaaatgcccgtggcaacagcaataacctctttaacatcaaagccgatcgcagctggcagggggataaagtcgcaacccaaaccttggaatatcacaacaatgttccagtggtggagaaagcggcatttcgctcttatgcgagctttgatgaaagctttaacgactatgttcgcttcttggaaaacaatccacgttataccaatgcgttggatcatggcggaaacagtgaacgctttatccacggtatccaccgtgctggatatgcgaccgacccgcaatacgccgacaaggtgctgcgtgtaaaagcgcaaatcgatcaaatgaatctgttataaatcgcccgccggaatatttccggcggcactctttctcgtcctcaatcttttcagcttaccaatcctaacttgctatttttattagagtaaatcgaatacatccaatctggcatacatattgctatctactgtttagattcagtgaattttactgattaatatcggttttcgggggcagtatggcgtctgatcttctgaatgtgggtacgcaaagcgtactgacggctcagagacaactcaataccacaggtcataacatttccaatgttaatacagagggttacagccgtcagtctgtgatccaagggaccaatgcgcctcgccaatacggcggtgaaacctatggtatgggtgtgcatgtggaaaatgttcgccgctcgtgggatcaatttgccgttaaagagctgaatattgcctctaccgattacgcttttaagcgagataccgaagaaaatctcgatatgctgtctaagctgctttcctctgtggcttcgaagaaaattcctgaaaacctcaatgagtggtttgattcagtaaaaagtttggctgattcgcccaatgatctgggtgcccgtaaagtggtgctcgaaaaatccaagctcatttcacaaaacctgaatgatttccatgagacggttcgtttacaaaaagacattaccaacaaagggttagctcttggcgtagaacgcatcaaccaactggcgttggaaattcgtgatttgcagcgtttgatgatgcgcgtaccagggccacataacgatttgatggataagcatgaaaagctggtatccgaactgtcgcaatacaccaaagtcacggtcacgcaaagaaaacatggtgaaggcttcaacattcatatcggcaacggccacactttggtttccggtactgaagccagccaactgagagtgattgacggtttcccagatacccagcaacaccgtttagccatggtggaaggcaaggcgctcaaagccatctccgcgcgtgatattggcggcaagatggaagccattttagatatgcgtgatgaacacattccgtacttgatggatgaagtcggtcgtctcgcactctccttttctcatgaagtgaataccttacagtcacaaggtttagatctacgtggcaatgtgggtagcgctctgtttaccgatgtcaatttggacgtcattgctcgctctcgtgtggtgaccaacagtaattctaaagccgatatggcggtatttattgaagatgttagccagctcaaaggtggcgaatactccatgcagtacaacggcagtgaatttgtggtgactttgccttcaggccaacaaaccgtgttgcccgtggtaaaaggcaatgtgtatgtcgatggcttacgcgtagaagtacgtaacccgccccaagtcggggagcgaattttggtgcgcccaactcgtaacggtgccgctgccattcgtttagcaactgaagatgcgacaaaaattgccgcacagagctttgaagcatcgaccacttttgcccaaggcaaagcgaaatttaagattttacaagcgggggatgttcgcgaatttgaagtgattgtctcgccaaccggcgatcaattcgcggtgaccgacaccaaaggcaatattttacttcagcctcagccttatccgccgactgggcctgtgaccgtattgggcactacctttgagctgacagaaggtgcgttacctaatgataagttcacggcaaaccttgtcccttcagaaggggataacggcaacttgcgtaaaatgatcaacattcaaaccgcaaaacggatgaatgataacgagtccaccatcatcgatctttaccacaacctcaacacggatgtggggctaaaaatggccaccatgacgcgtttgaccgatgtggcaagactggagaaagaggcggcgcaatcgcgcatcgcttcgatttccggtgtgaaccttgatgaagaagccgccaacatgatgaaatttcagcaagcttatatggcttcctcacgcatcattcaggcctcgaacgacactttcaacaccattttggcgttgcgatagggagatgggtaaatgttaaaccgaatctctagcttccataactaccaagcggttcagaacgacatccgtcgtcaggaatcgaaagtgtttaataaccaagcgcaattggcgtctggtaagaagctgttgtcagcgagtgacaacccactggcgacgcactacatccaaaacgttgggcaacaagaagagcagctgcgtcagtacctagatgcgatagtgctagtccgcaaccgtcttgagcatcaagaagtcattatttctaataccgaagagttttctgactccgcaaagcgcactgtgatggagatgatcaacggctcattgtcaccagaagatcgggtggcgcgtgcgcgcgtgttgcaagaaatggccaataactttattaacctcgccaacgtacaagatgaatccggcaactatatttttgccggtaccaaacccaaaaatcagcccttctttcgtgataaccaaggcaatgtgacctacgcgggggatgattatcagcgcaaaatgaagatctccaacagcttggaaattccatttaataacccaggcagcaaagtgtttatggagatccctaatccttttggcagctatgagcccaactatgcgctgcaagagggttccgagctgctcttagagcgtgcagttaacctcaatcccgatgataccgcatcctatcgtgtaacgtttgtcgatatgccggaaggcaaaaatggctatcagttagagcgtaatggcagcgtagtgcaagcgggagagtttgatgcgaaaaccggcatccagtttgaagagctgaatattcaggtcaaagggcagatcagcaaaggggatgcgattgagctgacgcctcgcaccacgtttagtgtgtttgatactttccgtgatgcgattcgctacgccgaagggtcggtatcggatgcctcgaatacggccaaactgcatcagttagttgaagaatttcataccgcctttatccatctcaataaaaccagaacggatattggtgcgcgtttgagtacgctcgatattcaggaagagcagcacgaagatttcaaaatcagcctcgcgaaatccaaaagtacctttgaggatctggattacgcagaagccgtgattgagttcaacgagaactcgcgagcccttgaggcatcgcagaaagcctttggtaaaacgaaagatctcaccctttttaactacatctaaccttcaatgccttatgcgcttaagccatatgagcgatcatcattattactcgagtgcggccgcattacatcaagttctgttctcgcacaagccaagcaggcacccaactcagcactggctcttctaggctagttcgagttgataggaaaaaacccagctgcagctgggttttttattgcctgtaatttgttggttttgtgtggcagagaaacctaaaaagaagaacgtaaaagagagaacgtcagcggccatcacgcaaaagagcgtataaatgcttagctaatggtggcgttgtgtcttatgtaaaggagcttagcttccgccggaaagcggcttaagttatggatgtggatgtgatgtcgctatcaataaagcccagataaaacaaaacctagccgaagctaggttgtttatatggtgcggaagaagagacttgaactcttacgcctcgcggcgccagaacctaaatctggtgcgtctaccaatttcgccacttccgcaaattktrttgataayytgattrctcamrtcatcgawrtaatggcaggtctgcyaggattcgaacctrggkatgacgggatcaaaacccgttgccttaccgcttggcgacagacctgcwrtgatgattwayatcatcaaaatatggtgcggaagaagagacttgaactcttacrcctygcggcgccagaacctaaatctggtgcgtctaccaatttcgccacttccgcaaatttgttacaactcgatrcatttggtgcggaaggagggacttgaaccctcacgtcckaaggacactaacacctgaagctagcgcgtctaccaattccgccaccaccgcgtgtcaaaagcatcaaattgtcaaaatwtggtggctacgacgggattygaacctgtgaccccatcattatgagtgatgtgctctaaccaactgagctacgtagccaaattttattttcttaacgagaaggcgatgccttatcgctgagaacggagcgcattatgcggatatgggttaggagcgtcaacagtttttttgaataaattctttgaaaccaaccgttcgggttttttttaaacaaagaggcgtgtttatgatcaaaaaccatcaccaaaacaacaaattcattacgcttggagagtcataaagatcattttttagaggcttataaatggcaaaagccaacactttggttggcttttggttcgcagtaaagcgagatttaaacgttgaagcggaagtggattacatcgccatcttttacgatgtactctttaccttccaagcgccatttaccggcatctttggcacctgactcaccattgaattggatgtagtcattgtaaccgatcacttcagcacgaataaaaccacgctcgaagtctgtgtggatcttacccgcggcttgtggtgcggtcgcaccgacaggaatggtccatgcgcgcacttctttcacgcctgcggtgaagtaagtttgcagattgagtaggtcataacctgagcgaatcacgcggttgaggcctggctcttcaataccgaggtcggctaagaactcatcgcgttcttcttcttcaagttcagacagttccgcctcgatcgctgcacaaaccgctaccacagaagcattttctttggctgcgaactcaaccaccgcatccagatatgggttgttttcaaaaccattttcattgacgttcgcaatgtacatggtgggttttagcgtcagcaggtttaaataaccgacggccagtaattcttctttggttaggttgacggaacgagccgattggccttcgctcagaacaggttgcagcttttcaagtaccgcgagttcaaatttggcttctttatcgccacctttagcgcgtttgctttgacgcagaatcgcgcgctcgcagctgtctaagtcagccagcgctaattcaagattgatgatttcgatgtcttccagcggtgacactttacccgccacgtgaatgatgttttcgttttcaaagcagcgtactacgtgaccaattgcatcagtttcacggatgttagcgaggaatttgttacctagaccttctccttttgatgcgcccgccactagacctgcaatgtccacaaactccatcgtcgttggcagaatgcgttcaggtttgacaatcgcggctaaggcatccagacgcggatctggtacaggcacaacgcctgtatttggttcgatagtacaaaacgggaagttagctgcttcgatgcccgctttggtcagcgcattaaaaagagttgatttacctacgtttggcaaaccgacgatgccacatttaaaacccatgactgtaaccttattcagctttgaaagtgtgtaaacgattttgtgctttggtgaggccatccttcatgaggatctcaaggcagcgaacggattcatccactgcggcatcaaggcattcttgctctttagcgggagctttgcctagtacataaccggctactttgtctttatgtcccggatggccgatgccaagccgtagacgatagaattctttgttgttgcctaatttgcttatggtgtctttgagcccattatgcccgccatgtccgccaccttgcttaaattttgccacaccgggtggtaagtctagctcatcgtgggcaaccatgatctcttctggcttgatctgatagaaattggccagtgcagcaatcgctttgccggagagattcatgaaagtggtggggattaacacgcgtaactcttggctgttaatcaacaaacgtccggtcagaccaaaaaacttcggctcatttttgagcgtgacgttatggatacgggctaactcttcgacaacccaagcacctgcattatggcgtgttttcgcgtattccggcccaggattggccagtccgacaaggagtttgattggttgactcaaggcgaatatctcttcggaaactcaaaagcgcggtatgatagcacacatccgccgcgaggtgcgagtcacacaaaaggcaataaaaaagcgcttcatcggagatgaaacgctttcgtatcatcgattccagagcttacctgacagcagatagactgggttactcaatgattagttaaacatcgcagagatggactcttcgttgctgatacgacgaatcgcttcagccagcatgcttgatagagtcaactgagtcacttttcctgtcgccgccatctcttttgatagggtgatagagtcagtcacaatcacttgatccaacacagagtttttgatgtttttcgctgcattgcctgagaataccgcgtgagtggcgtaagcaaatacgcgtttcgcaccacgctctttcagcgcttccgcggctttacacagtgtgccaccagtgtcgatcatgtcatcgacaatcacacagtcacggccttcaacatcaccgatcaggttcatgacttctgaaacgttcgcgcgtggacgacgcttatctacgatcgcgatatcgatgtcacccagtgctttcgcggttgcgcgagcacgcaccacaccaccaaggtctggcgatacgacaacaggatcttccaagttacgtgctttcatatcttccagcaggacaggggtaccgaaaatgttgtctactggaacatcgaagaagccttggatctgctctgcgtggaggtcgatagtcagaacgcggtcaacaccaacgttagaaaggaagtctgcaacaacttttgcagtgataggtacacgagccgagcgcacacggcggtcttggcgggcatagccgaagtaagggataactgccgtaatacggcctgcagaagcacggcgcattgcgtcaatcattaccaccagttccatcaggttgtcattggttggggcacaggtggattgaatgataaatacatcgctaccacgcacattttcgttgatttgtactgctacttcaccatcagagaaacgagaaacagtagcatcaccaagggaaatgtacaggcgatctgcaatacgttgggctagttcgggtattgcgttaccagcaaatagcttcatatcaggcacggtggaaacctcagggttgcgtccagttttttagtaaggtcggattttagctgattggtagtcagccaacgtctttctgagcggtgaaacattgcgcccttgggcgacaaacgctaagacgttgtcagataattgagcaaagacggcctgtgcatctttcctgctcgaaaactcagcaaaaacgcaagatcccgtcccggtcaatcttgacggcgcgtattgtagcagccatgaaagttgcttatcaacctcggggtacagtgatcggacaattttttcgcaatcgttttcgtacggggtggtaagaaggcttgccagatcacgctttggcgtgtttctcatcagctgtggatgagtgaaaatatcttttgtcgcgatgctgaccgcagggcgaaccacgagataccatttttcctctggctctactgcggataattcttcgccaactccttcagcaaaagccgcaaaaccacgagtaaagacagggacatccgctccgagtgccagcccaatttcagccaattgatcatcgctaagcccagtttgccacaagtaattgagtgcgactaaggtagtggccgcattggatgatccgccaccaattccgccgcccataggcaacaccttgtgcagttgaatgtctgcgccgagtggtgattgcgccgcatttttgagtgccatcgcggctttgtaaatcaggttatcttctaacgcgacatcggccagagcaggagagagggtgatgttgccgctgttgttggcggtaatggttaactcatcaccgtgatcgagaaactgaaacaaggtctgcagatcgtgatagccgttagctcgacgacctgtgatgtaaaggaacaggttgagtttggccggtgaaggccacacggttgtgccgtggatcatgggagcagcgtccattgtgagatcaccagttgaatcgaggttttattttgctggagtttaagtttatcaggcagcggaatgggctgatgttgccactcaatcgcttggtaacgttggtattctacgtgccattcctccgttgaggcgagtttggtgagagtggcaagagtgttttgttcattcaactcgtaatgggttgcttgggtcggcaagcctaaaatccaatcttcaagctgttcaacgggaatatctaaccctgttaaattgcggatcaggctttgtgcatcttggtcgcggtagatttgatcatcataagtttcgacccgcgcaccttgttcatcgacctgtaagttcagcacggtttgaccaagaaaattgcttaaacgcagtgagagtttttgtgggcttttttgccattgaaagttgaacgattgtcgctgatcgggcgcgatatagccgagttttccggttaattgataatgttgaatttgttctagagtgacttggtgtgattgccattgaacattgacgggttgtagcggtgcggtggcacaacctgccaaaagcaacagactcgccaatcctggcagtaggcgacgtacgagagcattcatagtgcgttttttatccaaagcgagagcgaaaacgggctaactatatcattgatctcacgaactcaggaaaacaaatccggtctgccctttcaatcaaagagggcatcaagtaaaattccgcctctagtccaccacacatatctgagaatcctctatagatgtctttgcttgccattggaatcaatcacaatacggcgtcggtagaattgcgggaaaaagtggcgttcggtccagagaagctctctttggcgctgaatcagctttccaccagttcacacgttaaaggaggcgtgatcctctcaacgtgtaaccgcaccgaaatttattgtgatgtgagatcagcaagtaaaaacaaagtcatcgaatggttgtcccagtttcaccaagtcagcttggatgagttaaaacccagcctatacgttcatgaagagcaagccgccattcgtcatttgatgcgtgtcgcctgtggtttggactctctagtgttgggcgagccgcagatattaggacaagttaagcaagcttacgcagaggcgagagagaatcacgccgtcaatccggcgacggaaaagctgtttcaaaaggctttttcggtcgcgaaacgggtaagaacagaaaccgaaatcggcggcagcgcggtttcggtcgcttatgccgcttgcactttagcaaaacacatttttgaatcgctggccgacgctacggtactgttggtcggggctggtgaaaccattgaactggtagcaaaacatttggccggacaccactgtaaacggatgatagtggcgaaccgcacgcgagagcgagctttgagcttagcgcagcagtttggcgccgacgtcatcgcattaaatgagatcccagactatttagcgcaagcggatattgtgatcagctcgaccgctagccctttgcccatcataggtaaaggcatggtcgaaagtgcactaaaggcccgtcgccatcagcctatgttgttggtggatattgccgtgccacgcgatattgagccgcaggtcggtaagcttaacgatgcttatctctattcggtcgatgacttgcagtcgattgtcgatagcaatatcgagcagcgcaaagtggaagcgattcaggcagaagcgattgtcagtgaagagagcgccaccttcatgagttggatgcgctcactgcaagcggtggacagtattcgtgattatcgtaagcaagccaatgaagcgcgtgaagagctactcaataaaagtttgcaagcattggcagcgggtggcgatcctgaaaagctgctcatagaattaagcaacaaactgaccaacaaactaattcacaccccaacccgagcgctacaaaccgcggcggaacaaggggaaccggctaaactggccgtgatcagacaaagtttaggtcttgacgatctgaactaaatctcaacttagagtttaaagaagcaactatgaaagcgtcgattttaagcaagcttgaatcccttgttgagcgctatgaagaggttcagcacctccttggcgacccaacagttatcggtgatcaaaataaattccgtgctctatccaaagagtattcgcaactggaagagatcactcagtgtttccaagcttaccaacaagcgaaggaagatctggttgctgccgaagagatggcacaagaagatgatgcagaaatgcgtgaaatggcacaggacgagatcaaagcggcgaaagcggcaattgagcgcctgaccgatgaactgcaaattctgttgctgccaaaagatccaaacgatgatcgcaactgtttcttagaaattcgcgcgggtgcgggtggtgacgaagcgggtatttttgccggcgatttgttccgtatgtacagccgttttgcggagaaaaaaggctggcgcatcgaagtgatgtcatcgagtgaagcggaacacggcggctacaaagagatgatcgcgaaagtgaacggtgacggtgcttacggtacgctcaagtttgaatctggcggccaccgagtgcaacgtgttccggctacggaagcgcaagggcgtatccacacgtccgcttgtaccgttgcggtgatgcctgaaattcctgaagcggaaattccagaaatcaaagccagcgatctgaaaattgatacgttccgctcttctggcgcgggtggtcagcacgttaacaccaccgattcggctatccgtatcactcacttaccgactggtattgtggtcgagtgtcaggatgagcgttcgcaacataagaacaaagctaaagcgatgtcagtattggctgcacgtattgctcaagctgaagagtcaaaacgcgctgcggaaatttccgatacacgccgcaaccttctgggttcaggcgatcgtagtgaccgcattcgcacttataactacccgcaaggtcgagtgtccgatcaccgtatcaatttgacggtatatcgcctgaccgaagtgatggaaggggatatgcaatccttgattgaccctgtgattcacgagcatcaagcggatcaattggcggcactggcggatcaaaactaatccatgtcagttaccattgaagcggcattaaaagcggcaaccgagcaactgcagcaaagcggcagtgattcgccagccctagatgccgcagtactcctttgccatgtactggctaagcctcgttcttacttgttgacttggcctgataaaatcttggagaagcctactttggcttctctcgagctgctccttgctcgccgcagagcgggagagccgatggcctacatccttggtgagcgcgaattttggtcgctgccgctgaaagtctctccttcgacacttattccacgtccggatacggaacgtttggttgaattagcgctggataaagcggcgttgattgatggcgaactgctggatcttggcaccggaactggggcgattgcgttggctttggcttcggaattgcccacgcggcaagtcacggggattgatttacgtccggaggcggcagagttagcaagagaaaacgcgactcgcttggcgatccacaatgcgcagttttttcagggcagttggtttagcccattagcagacggtacgaagtttgctttgatcgtctccaacccgccttatatcgaagaaaatgatccgcatttgagtctgggcgatgtgcgttttgagccgaaaagcgcgctggttgccgcagaaaatggtttggcggacattcgccacatcagcacgcacgcgccgcattttttgctcgatggcggctggcttttgtttgagcatggttacgatcaaggcgttgcggtgcgcacgattttgcgtgatttaggctatcaaaacatcattaccgagcaagattatgccggtcatgatcgagttacactgggacaatataaaacggaaagagaagcataatgtacgaaggattaaaacattttcacctgttcactatcggcgtcagcgtagtcatgctgtcgattcgctatgtgctcatgatgatgaattcagcacacctagagcgtaagtttttcaaaattttcccgcatgtgaatgacacgttattgctgctttccggtatcggtttgatattcatcactggattcattccatttaccgctgccgcgccgtggatgacagaaaaatttacctgcgtgctggcgtacatcgcgctaggcttttttgcactgaaattaggtcgtaataaattgctgcgtagctttgcgttttttggcgcgttgggctggttggcgatggctggaaaaatcgcggtcgccaaagcgccgattctgtttggttaagcttaaggtgcgaccatgctgaatttatgtgatgaagattttgatgcgatggagttggtggaaggggcgcttgcgctcaacaaagccattaatcccgaaacgcagctagaatgggctcacatcgagttagcacgtctgctaaaagaagccgaactggcactggtacatgagcgtgatgagaaagcgcgtttcgaggcttttttgcgcctgttttatcaagagtggggctttagcggcgatcgcgaagcctactttgattctcgcaatgcctttattgatcaagtgttgcagcggcgcaaaggtattcctgtcagtttaggctcattactgctctacctaggacacaaactcggctttccactcaatggcataagtttcccgactcagtttctgctgtcgctcaattggtcgggagagcggccgatttatctcaatccatttaatggcgagatcgtgtcacaacatacactgcaagcttggttagttgggcacaaaggcccactggccaagcttaagccacagcatttacaaagtgtcgataatccgaccattattgggcgttggttggcgctactcaaaagtgccttactgcgtgaagagcgctatactctggcgctaagatgtaccgatttggcactcacttttgtgcccgatgacccatacgaaatccgtgatcgtggctttatttatcaacagctacagtgccatcaaattgctatttcggactatcaatattttattgagcactgtccgaacgatccggcggctgaattgttaaaaacgcaagtcaatgcactcagtcacgacagtcaagtgacgctgcattaacccaacaagagagattaagatggaacacaaaattgtccatgtcggtgatattccggttgccaacgataagccgtttaccctatttgcagggatgaacgtactggaatcgcgtgatttggcgatgcaaatttgcgagcactacgtgaaagtgaccgacaagctcggtatcccttatgtgttcaaagcatcgtttgataaagcgaaccgcagttcagtgcactcttaccgtggcccaggcttggaagaagggatgaaaattttccaagagctgaaagagacctttggcgtgaagatcatcactgatgtccacacagaagcgcaagcgcagcctgtggcggatgtggtggatgtgattcaactgcctgcctttttggcccgtcaaaccgacttggttgaagcgatggcgaaaaccggcgcggtcattaacgtgaaaaaaccgcagttcatgagcccgggtcaagttggcaacatcgttgagaagtttgctgagtgtggcaatgacaaagtgatcttatgtgagcgcggctcttgccacggctacgataacctcgtcgtcgatatgctcggctttggtgtgatgaagcaagcctctaacggcagtccaatcatttttgatgtgactcactcactgcaaatgcgtgatccatcaggtgcggcatcgggcggtcgtcgtgagcagaccgttgaactggcgaaagccggtttggcgacggggattgcgggtctgtttattgaagcgcaccccaatccagataaagcgcgttgcgatggcccatcggcattacctctcgacaaattagagccattccttgcgcaaatgaaagcgctggatgatttgatcaaaagctttgcgcacatcgatattcgataagcgcgatagcctgactctatattgtattgcaagccatcttcggatggcttttttcatgtctatacccttcctacttgaagctgcagcggtgttggctacgttcgttcaccccaatcacatagtctatctatgctcatggggactcactcactgccgcctacctgcaactccaagtagtttgggtataacgcctatcaatacggctctgtttcagcaaacgacggtttctgtagattaaacgcttgcgcgcacaaaacggcttaaaagcccatcccattagtcaaacgtttgcctgtgatccgagcaggttatctttttaactctttctattgattacattatattggctacttttaggtgatctactctacataaatatgaaatcaagctgtctcaccaagtcggttactttaaactaagtcaagttttatccgcactccaagcaatgtgctcaagcgatgtgctgtggtaaacgactgcgccgtgcgagcgcccaacgacatttcaagcagtggttttcatcagttcaaaggtatgacaatgaaacaaggcctcattctaaaatccgtcctcagtgcagccattattgcctctttggcaggttgtgcaactgcacccgctcagcagtgggaagcagacaaaacctacaaactcactattctgcacaccaacgaccaccatggccgtttctggcaaaaccagtatggtgaatatggcatggcagcacgtaaaacgctgattgatcaactgcgtgccgacattgaagctcaaggtggcagcgtattactgctctcgggtggtgacatcaatactggggtaccagaatcagacctacaagatgcagagcctgatttcaaaggtatgagcaaaatcggttacgacgctatggcgctgggtaaccacgaatttgataatccacttgaagtgctgtttaagcaaaaagagtgggcgaacttcccaatgctgtcggccaacatttacgataaagcgaccggtaagcgtctgtttgaaccgtaccatatctttgataagcaagggattaagattgcggttattggcttaaccaccgaagacaccgcgaaaattggtaacccagaatacatcggtggtatcgacttccgcgatccgaaagaagaagcgaagaaagtgatcgctgagctgaagaaaaaagagaagccagatcttatcatcgcagtaacgcacatgggtcactaccaaaacggtgagcatggtgtgaacgcaccgggtgatgttgctttggcgcgctacttaccagcgggtgagttggatatgattgtcggcggtcactcacaagagcctgtgtgtatggaaggccctaatctggtgaaaaagaactttaagccgggtgacgaatgtaagcctgatattcaaaacggcacttacattgttcaagcttacgagtggggtaaatacgtcggtcgtgcggattatgaattccgtaacggtgagctgaatatggtcagctataacctcattcccgttaacttgaagaagaaagttgaagtgaatggtgaaactcagcgtgtgtttgcgacttctgaaattaaagaagacagcgcaatgctagagttcctgcgcccattccaagagaaaggccaagagcaactgagcatcaagattgcccacagtaacggtaagctagaaggcgatcgtaacgtggtgcgttttgagcaaaccaacttgggccgcatgattgcaatggcgcacatgcaacgtgctaaagccgattttgcggtaatgaactctggtggcgtacgtgattctatccaagccggtgacattacgtataaagatgtactgaaagtgcagccatttggcaacatcgtcagctacgtggatatgaatggtcaggaagtgctggattatctcaatgtcgtcgctaccaagccggtcgattcaggtgcgtatgcccagttcgcagggatttcaatgacggttgcggatggcaaagtctctaacgtggtcatcggtggcaaacaactgcgtctcgatgcgacctaccgtttcactgtgccaagttttaacgcagcgggtggtgacggttatccaaaaattactgaccacccaggctatgtcaacactggctttgtggatgccgaagtactgaaagattaccttgaggcgaacagtccaatcgatgtgaaccgtttcgcgccagcgggcgagattgtttatcgttaataaggtttgactcgcaaagttgaattgcgtttactgacaggcggtgtgcaaacaccgccttttttgttttgccatacccatatggcccgagctctgcccatcagcagtgtgagtaaatgaggacacgtgattcatgactcctgcaatcaatcttgcaaagaaaaataaaatctcccataccatccatcagtatgaacatgatccgagccatgccagttatggcctagaagcggcgcaggcgctcggtcaagatccgaagcgcgtattcaaaaccttactgttttgtatgaatggcgaggaaaaaaatctcgcggtagcgattattcctgtcgatctcaaactgaatttaaagctcgcggccaaagcggccaaagccaaaaaagccgagatggccaaaccagagattgctgagaaaaccacaggttatgtggtgggggggataagtcctctcggccagaaaaaagcgctgccaacctttattcatcaaagtgcgcaaagccaagcgacgatttgtgtcagtgcgggtaaacgtggtttagaaattgagttatcaccgcaagatctcgcgcgcttaacccgtggccagtttgcggatttgtgtcaagaagagaattaatcgatacccctgtaaaaacggcctcaaagggaggccgttgattctagaagtggtgagaagtcagcgaagattaatggcgtgcttcttcttccatttgtgcattgtccactacgtggttttcacctaagtcgtttggcagaacgaggttgagcacaatggcgacgataccgcacaagctcacgccttgcaggctaaagtcacccacgccgaatgccataccaccaataccaaagaccagagtgacggccacaatcaccagattgcgtgatttgtgcagatccacttggtttttgatcagcgtattcaaaccgacggtggcgatggatccaaacagtagaatcatgatgccgcccatgaccggaaccggaatggtttgcagcagtgcaccgagtttgcccaccaaagcaagtacgatggccgtgatggccgcccaagtcatgatcgctgggttaaatgcacgagtcagcatcacggcaccagtcacttcactgtatgtggtgttgggtggcgcgccaagcatggttgcggccatggtcgcgaccccgtcaccagcgatagtgcggtgtaagcccggtttttttaggtaatctttgttggtcacatttgagatagccagcatatcgcccacgtgttcgaccgcaggagcaatcgcgactgggatcataaacaggatggcgttgatgttaaattcagggaaagtgaagttgggtaacgcaagccaagcggcttgttccaccgccgcaaagctgacgacacccattaccagtgagactgcatagccgctgacaatgcccgctaggataggaactagcttaaaaaagcctttagcgaagacactgaataccactgtgaccaaaagtgaaatacaagaaatccagagtgcggcttgtggatcgacgagttgtacggagccatccccggttttgcccagtgccatgttcacggcggctggcgcaagtcccagaccaatcaccataatcacaggaccgactacgacaggaggcagcagtttgtggatgatggccacaccacgcaccttaataatgccaccgagtacgatatacaccgcaccagcggccatcaagccacccatagtggcaggaatgccccaggtttggatgccgaacataataggagcgataaaagcaaaagaagaggcgaggaaaatggggacagagcggcgggtgatcaattggaaaagcagtgttcctaaaccagcaccgaatagtgcaacgtttggatcgagtccggtcagaagcgggaccagaaccaacgcgccgaatgcgacaaacagcatttgcgcgccttgtatggcatttttcatcgtattttccctgagctaaataaaaattcgcgggattctatcacttctgcaatcgattgcgagcggaaaaagatcaaaaattgacaggattattggctatgtttaaaaacgacgtggatcgcgtcgcacaaattctgacgcactcctgtaacctctcgccttgctgaactttagatagttgcttatcatcgtcgttcagtaaacagaatgtaggtatggtatgcgctatttagctgtgttgatgatgggattgctcacgtttcccgccttcgccctcactcgagtcaacttgtatcaggcagaagttgcggtcgatccgcagcaaagtaacgctgatgcggcggcgcgtgtccgtggtatggaagaagtgattgtccgcgctactggtagccaagatgcgctcaaaaatgatgctgtgcaaaaagctttgcgtcagagtaaccagtacatcacccagatcagcactcaacaagagggtgctcagtcggtgatgcgtttgcaattcagcgcgcagcacattcgctcactgttaagtcaagctcagttgccattctggcctgaaagccgcagtaatttgctggtatggctggtggaagaagccaactacgatcgcagcgtgagttgggaacatgcagatacgccgttactgaaccaaatgaaagttcgcgcccgtattcgcggcttacccttaacggttccggttggtgattttgatgatgtaaccggtgtgcaggtctccgatttatggggcggctttatcaacccgatcagcatcgcaagtcaacgttatccgaccgatgcggttttggtcgtgcgtgctcaaggctctgaactgcgttggactctgtttgatcagttggctaacaccatggtgagtcaaccgaaagcgcctatctcaggtcaagcctcgggtgagcaagcggtcaccgagatgattgatgaaatcagtgattactacgcgcgtaaaagcgcggttgtagtaagcagtgaatcctcgcaatcggtattggcgcaatttagcccactcgatagcgcgcaggatttctttgtggttgagaataaactcaagcgcttaagctcagttgcttcgctagatattttgaaggttcaaggtactcaagtgacctttaacgtgcatttattggccagtgtggaagagttcactaatgaagtggtgcgcatggggcaggcagtattgatggagatgccgccagaagagcccgtctctgcagacaataatttgctggaaaatagttcactggaaaatagtgcgtcagaaatgccggtagacccgagcaacccaaataacgctgctgctcagccacaacctgttcaacctaaaactctctatttctcttggcaaggttaatgctttgaggagagagccccaaatgacttgaattgtcaggaaggtaggggataaaccaaagcaaaaaatagcgccgaaaaaggcgctatttttattgtcatccctaaaccaccgcttttagcggtggtgattgttttcgattattactttccaagtggtttttatgcgcactcagccaagcaatgagtcaccgataggcaaaaagatcattggtggtcaaaatgggctttttcttgcttttccacttcagaaagcttggtcagctttaagcctaactccttaccacgtaagcgcgcataaagggtattgccgataaatgccgcaaaagtcagtagcagttctaccaaggctaaccaacgctccccgccatccacatacagcaaggtcaacgcatgcaagaaatagagcatcaaaacaaagtttgcccaagcatgggtataaggtttgcctttgagaatgccaaacagaggcagtagcagtggaatgacccagcctatcgcgagcgcggtaggattaagatgaggatgtggtgacaacgtgagttgccataacaggatccaaaccaacagagcgaggttggcactcagtgccagccagcgataaaacgcggtccgaggttgcattgcaatactggaggtggtcattgttatccctttaactgtttggccacatgagccaggcgctttcctagctggcgtgccagctccgcctcttcactagagagtgttttttgttgatggacatggcttgcaccatacggtgtaccgccggattgggtggtgtgcaaggctggctcggaataaggtatccctaaaatcaacatgccatgatgcagcaaaggtagcatcatactctgctgggttgtttcctgcccaccatgcaaggttgatgaagacgtgaacacgcaagctggtttatcaatcagcgcgccactcagccaaagtggcgtggtttgatcccaaaaatgttttaatggcgcggccatattgccaaaccaaactgggctgcccaacgctaagccgtcacactgtttcaactcatcaaggctaaggtaaggatcgctgttgcttgccgtgccatcaagctctgcgacggttcgcagcaaggcttggcaaccttctacggattccacgccgcgggcaatttggcgtgccaatgcttgcgtactaccgtgacggctataatagagcaccactatcgaaatcatagaatttcaagcacttgttctggtggtcggccatgacgagcttgaccgttgcacaccacaatcgggcgctcaatcagtttcgggtgttccgccatcgcggcaaacagcgcatcatcgctcaattgactatcccctaaattgagctctttatacagctcttctttgcagcgcatcatggcacgcacttcattcagccccaattgttggtagagacgcttgagttcttccaccgaaggtgaggtttctaaatacttaatcacttgcggtgcaatgccttggttttcgagtaaggctaacgtttcacggcttttggagcatttaggattgtgataaatcacgactgacataacttctcctgtatcagatttattattggagggataaaaagcgctcgcgttgcaccattaactggtcaatccgcgcatcgtaacgggcttgcgccaagctacccaattccaccaactgactggcttgggtataaaactgaatcgctttgttccagtttgcttgcagcgccatgatttcaccgcgtgccgctaagtcttccgcactgttgcctaaacggctattggcttcagacagtagttgccaaccattgatgtcattaggattgtcatgggtgtaacgttgcaagattcgaatggcatcggtgaacttatcttgcttaagcagcacattcgcatagttaatggtcaacactgagttatttggcgtctgcttgagcgccttttctaacaagctttgtgctttatcggcttgcttgagctcaatatacaaatcgctgatcgcatcgagataaaaatgattgtccggttgttctttaactagctgggtcaacagtggctctgctttatcgaactgtttgagatcgagatagaccaaggctttgccgtactggatagacggctgtagggtggcgtcgatttttttctcactgcgagcaaaccaatccaacgctgcgtcggcatcaatgcctgcataacgagcgatgatccgtgcgcgcgccaaatgataatccaagtgtggagcaagtttgagtggcggatattgtctggcccgctcacggctatcggtaatccggtcttctggtagtgggtgagtcagcagcatagggggcggcttactggcgtagcgatattcatcagcaaggcgagtgaaaaattgcggcatggcgttggcgtcaaatccggctttggctaaggtcgcgataccaaatcgatccgcttctttttcattgctacgcgtgtagttaatctggccttggatgctgcccgccatggtggcgttgatcgccgcaattcctgcttctggggcggcaatcgccagcagtaatgaaccggcgagcgctgcgattgtcgcgggagagcggcgtgcttgttcttccatgctgcgcgcaaggtggcgttgggtgacgtgagcaatttcatgcgccatgaccgacgctaactcactttcactttgcgcatgaaggaacaacccagagtgcaaggcgacgtaaccaccaaaaaaggcaaaagcgttgatgttacgatcgcggatcataaaaaaggtgaacggcgttttgacatcgttggcgctggcgactaaacgatgtcctaaattatcaatgtactcattgagcacaggatcgttaatcacaggttggttattgcgcagcatacgcatataagcatcgccataaatcagttcttgatctatggtcagcgtcgagcccgctaccgtgccaatatccggcaattcgataggatcattttgtgcgatggcaggaagacatggcgctgcaatgcatagacataacagggtacgtgtcgggaagaatttcataatggcggtgcatactccgagtttatctgcctgtaagacatatccgatgtctattggtttcttgatttggcgttcgagcagtgaatttcctgtcaaaatcgaccacccattaacgccaattaggtgtaaccctgaacgaaagccgatacaatgtgccacctatattaaggattaagcggcagaatggaaccgattattctcgatttgcgggagcagcgttgccctatgacgttactactggttaaacgagccgcggcagctctatcgcccggtgaatcgctgaccattttgattgccgatcccgcctcacaacgtgacattgaaaagtatattgctcaacagccgctggattgtcagcgcactctaaatcacgatcactgttcgctcaaggttagtaaggagacttcgtttaatgtttgaaatggtcagtcgttggtataagcgacgcttctccgatccacacgctgccagcttggtggcgattttgttgtttggttttatcaccatctacttctttggtcatttgattgcccctttattggtggcaattgtactcgcctatctgcttgagtggcccgttactcaactgcgtcgattacgaattccgcgcaccttagcggtgatcattgtgattacggtgttcactggcttgatgattttggcggtgtttggtttggtgccaacgatttggaagcaggtggggaatttaattaacgacgtgccgaatatgtacaatggtacgcagaaattcatcaccagtctgcctgaacgttatccggaattggcacatctagagattgtcgaatcggtaatcggtaatgcgaaaaacaaagtgctaggcatgggcgaatcggtggtaaaaggttctcttgcgtctctggtcagcttagccacgctaggggtttatctgattttggtgcctctattagtgttcttcttgttgaaagataaacaagagatgctgcggatggcgagtggcattttgccgcgtaaccgcaagttggcgaataaagtttgggaagagatgaaccaacaaatctccaactacattcgtggcaaagtgctggagattgttatcgtcggcacagtcagttacatcacgttcgcgattttagatctgcgttattccgtattgctggcagtcgcagtcgggctttcggtattgatcccttatatcggcgctgcagctgtaaccgtacctgttgcgattgtggccttgttccaatgggggctgaccccgcagttttacaccttgttgattgcttacggcattattcaggctttggacggtaacgttttagtgcccgtacttttctctgaagcggtgaacctacacccggttgcgatcattattgcggtactcgtatttggcggattatggggcttctggggcgtgttttttgcgatcccattagccactctcgttaaggcggtgtggaaagccttaccaagtattgatgaagagcccgcttcctaaagaggcctagtggtgaacaaaaaaccagcattttgctggttttttattgtcattgagtccaaaacgaaaatttcagactaaagtttgtagagagagttggcgatatagctcctataacaaaaccaatttaatcaacactatttatcgcaaatgggcaaatcagggacccagaacagaaggatcggacattatgaggtttagtcagaagatcgttgccgcttcatcggcattactactctgtgttattgcactgctgtcattccaacagctctccaccgttcgtgaggagattgagtcactcgttcaagatagcttgatggagatggtgaaaggggtcaaaaacacaattgagtcagatcttgccagtaaaaagggattagcgcagtcgaccactgagattttacagcttgatccaaccaacaaagcatttgctaagagtgttttagaatcccccaacctaaaagggagctttttagcgattggtcttggctatgaatctgatgcgaccgtggtcgaaaatgatgatggttgggagccaaacgcagattacgacccacgtaagcgtccttggtatgtggatgctaagcgtgaaagaaagctagtggtcaccgagccttatgtcgatatctcgaccaagaaaatcatcatctctatcggtacgccagtttatcagcagagtaactttgttggtgccatgttctatgacgtagagctgactcagttggcgcaattggttaactctgtgaatctgtttgatgcgggttacttattcatcacgacgaaagacggcgttaccattgctcacccgaatgcggaaaacaatggcgaaaaattcagtcagtttttaccgaatgtcgatctgaaagaaggaacccaacggattgagctggacggtaaatactatctggttaaatttgcccaagtgccatctgagagttggtatatcggcgctgtggtggatgaatcgatcgcgtttgcgatggtggatgatttacgccacagctcattgatttataccgttattggcgtattgctcagtatcattggcttaagcttcctaatcaaagtgctgatgaagcctctgggtgcgctgagtcgagccattgaagatgtagcttcaggtcaaggggatttaactaaacgtttggacaccaacaccgatatggaatttgcaatattggcgaaggatttcaacgtgttctgcgaaacgttgcaaaaacgtatccaacacctaaaagggattggcgcggaaatcatgcatggtaccgagcaaacggtactgggtgcgcatgagtcggccagtgccatggcgcagcagttgcaagagttggagcagctcgcgacggcaatgcatgagatggcggtaacggcgacagaagtagcgaataacgcgcaaggagcagcggctgcggctcacgaggctgatgaagcttcacaagatggcagtaaagtggtgagtgataccacgcgatcgattgatgcgctttctgctcgtatcgaacaagcggtagaagaggtcaaaggactagaagtggcgaccggaaatatcgaaaccattttgaaagttattaacgatattgctgatcaaaccaacttgctggcacttaatgcggcgattgaagccgcgcgcgcgggggaatcgggtcgaggttttgcggtggttgccgatgaagttcggacgttggcacagcgtacgcaacaatcgaccacggaaattcgcaatatgatcgaacagttgcaaagcggtgcgagtgcggtttctgctgcgatgaatgagagtaagtacacggcggatgatgctgtgcagaaggcgcagcttgctaatgaatctttgcaacggattcgtggtgctatccaacggatcagcgatatgaacatgcagattgcttctgcagcggaagagcaaagtctcgttgccgaggagatcaacaccaatacggtgaagattaaagacctctcgactcaggtggcggactccgctaaatcagcgagtatggccatggaagtacaaaccgaaaacgtgcgcgagcaaggcaaactcctcaatacctttattgtgtagcgttttgacctatgcatttcgaatgccaataataaggccagtcaatgactggccttaatcttttctgtatttaaacggactaaaatcggcatttctaccgattatttaccgctgagataagccagtaccacttcatggtgattgctggttttaaacttatcaaagacttgctcaatcacaccttgttcattgatcaaaaagctgatgcgatgtaagccatcaaagactttacccataaactttttctcaccccatacgccaaactgttcagccacttggtgatcttcatctgataacagtgagaagttgagattatcacgctcaatgaacttgcctaatcgcttcacggggtcggtactcacccccagcactaccacattgtgtccttgcagctccgcttgaatatcgcgtagtccttgtgcctgcactgtgcagcctggcgtcatggctttggggtaaaagtagagcagaacttttttgcctgcaaaatccgcaagcgttacaggattgccattttgatctggtaaagagaaagccggagctggagttccagcagtaagcgtattcataattatccctttgattactgactgttttttataaagttaagtgaaccctgaacatcaagtgctgtacataaggcatcaaactcttcttgcaactgcatgaggttacaacctgagtccactcgcgcgctgatggcgatgtggaactgattttgctcactgtgcagtttgtctttgctgatggtttgtgcgcttagtgatgccataccgatttggcgctgtgcgaaaaattgggtgaacttttcggtcagccccagtttatcgtcagactctacgtacacttccacggtataagcgtgggtttgatgatcatgaggtgatgtacgtttcatcatggtgatcagatcatgctgttggccaagcaaaggtaacgtggtttcgacgcgagtaatgttgcttggggagccagaaattaacatcaaaagtgtaaattcttttccaaacatagcgatgcggctatcaataatgttgcaacccgcttgggtcactaatcgaaccacttcgttacaaatgccgggtctgtcagtgcccacggcggtgatcacaagatgctgagtcatactgtcactttagagatgatttttcgggcatgttaacacagttaaactagagaaaaagcgtgaccaagtgcgtttttccgtgcgctcaccctgaaaatgaccacagtttgacacctacgacgaagtgccgtgtataaaggtcactcgtcttgcccgccatttattgagggcatcttatcaatattcatccgcatggtgatttaagcccatttctccgcttgtctttttttagtgccatgcattaccatgctgagagtatcagattagggagatagacatgttttcaggaagtatcgttgcgttaattaccccatttactccggacggtgaagtcgattatatcagcctgaaaaagctggtcgatttccatgttgatgcaggaaccgatgcgattgtttccgttggcaccaccggtgaatccgcgacgctaacggtcgaagaacacgtgaaagtagtagcaaaaacggtggagttcgctgaaggtcgtctgcctattattgctggaacaggcgcaaatgcgacccatgaagcggtcacttttagccgcctgctgaacaacacaggtattgcagggtatttgagtgtcacgccttattacaataagccgacccaagaaggtctgttcctgcactacaacgcgattgcgcaagaaaccgatattcccgtgattttgtacaacgtgccgggacgtaccgctgtggatatgcgtccagaaaccgttgcccgtttatctgaaatcaagaacattgtcgcactgaaagatgcaaccggtgatttaagccgtgttgcgaagcaccgtgagatgtgtaaagaaggttttgtcctactcagcggtgatgatgccacaggccttgagttcgtcaaactcggggggcaaggtgtgatttcagtgaccaacaatatcgctgctgccgacatggcgaagatgatgcatttggcgctggatggtaagtttgatgaagcggcgatcatcaaccaacgtttgatgactctgcataaaaatctgtttatcgaatcgagcccaattccagtgaaatgggcagcccataagatgggattgattgcaaatggtgatctgcgtctacctttgacgcaactttcggaaccagcacgcccaatcgttgcccaagccctgtctgaagcctgtatttattaaggcgcgatccattacaatgccggggtatcatgaccccggcaatttttaggagtttcaatgaagttttctcgccagctagttctcggttcactggctgttttggttttaagtgcttgctccagcagccccacgcaacgacgccaagccaaagacgatttcgactatctcgaaaccacagaatttaagccttgggttttgccacaaggtgccactccgcagttttatcctaactatgatattccgcagggggcgtttcatggtggcgtgggcaatgtggtcgatattcgcccgccacaacaagtgttggaactcatccctggtgctcgcgcagaacgtcaaaatggcgaagtgaccttatggatgttgcgccaagatgaagcgcaaaaagtgtgggataccgcactgaaaatgattgcggagcgcaaaatccctcttcgtaagcaaaccgattctatggtggaaacggactgggtcgattgggtatcagaagatgaagatgtgacgattggtagccgctacttaatgtcgatggtggaaaccaataatcgttatggctttaaaatttcgctgattggttggcgtgaaaatggtcaagtgcaaacggtcagtaccaccaataaagagcgttacaacgcctttatgaccaacttggtcaccactcgttacgactccgatgtgcgtgcggaagcggcgcgccgtgcccaagagctggttaagcaaattccgattaccatgggctcagatcgcagtggattccctgtgatcattgcgcgtacgccttacgatgtactgtggcaacgtttgccagagttactgcccaaaatgggctttactattgaagagcgtaaccagtcacaaggtacggtcaaagccaaatacgctgcaccagatgatgaattctggcaacaggttggtgttaaaccgattgagcttaaatccgggacttacaccttcctctttggtgacttgggtaaccgtacgtcgattaacgtgaccgactcagcgggtaaaccggtcaacgaagcgctgttgaaagagatggtgccagtgctctcagcagtggtggataagaagtaatgaaaaagaagggatgccaaggcatccctttgtttttgtggtcatccctaaaccaccgtttttagcggtagtcattgttttgcgatttgtcgttacccgttatctttaggttcagagggagtatccgtgcctttgggtgagcgcggatatctcttctgatccagttcattcagccgatcaagttcgctttttttatccatttgcccaaatttcatgttggcggtgtatttaagcgcggcaatattcccgacaatcacggcgaccacaatcaacgagatcacccaagggttaaacagtatctccatgttatacctcacaaatattcgtgatgaagcgctgataaatctccggcaacagcgcttggactgtcgtttttccttccatcgctacggcagagagctgctcaagcaataggggctcacttagtgctgctaagcattgctgcgcagtctgtttatgactgatatgccaaggttcaaagccaatgccttgaccatgctgatagggtaggaaaaaaccaaattgagcaagatgtgcgtttagccattgagagaactcactttgatgcccttcaagatattcccacggttcaagcagcagactggtgttctctggtaaagcatcgcggtcatacacatcaaaatccgttccccaatggtgacgacttgcgcccggcaaggctgaccagcgtaatatggctaacactttttcagcttcactcagtgtgttgctatgcaatggctggctatgttcatcgagcagcggtttttgaccgagcattttctggttccagatcgccagttggcgttcaaaggagcgaaaaccactggcgatacaaagattaaaccctgcatcttgcgccgcttgcttgagtgctaaaagatccggactcacttgcggatgcacttgaaacgctttttgtccgaccattacggagatcaaatgtgtgtcggtttgcccggtcagctgctctggggtcatagttagcctaaaagatgatttaaggttttttgatacatatcggtcaatttctctaaatccgcaatacgtacacactcgtttaccttgtgaatggtggcattgacgggaccgagctcaaccacttgtgcgcccatttgggcaatgaagcgaccatcagatgttccgcctgtcgtcaataacgcaggagcttgatggtttacttcctctactgccgcgactactgcggccagtagttcgcccgtatcggtcaggaagggttggccgctgagagtccatttcacatcgtaatcgagcccgtgagcatccaagaccgaatgtacgcggcgtttgatctcttcatcggtgagctctgtactaaagcggaagttaaactgcacatcaaattcaccggggatgacattcgatgcgccagtacccgcttgcaggttaggaatttgaaagctggtgggggggaaataggcgttaccttcatcccattgggtggcggcgagttcggccaatgcggggagcgctttatgcacgggattattagccagatgcggataagcaacatggccttgagtgccttttaccttcaaatcccccgtgatggagccacgacggccatttttcaccacatcgcctacggctagggtactggacggctcaccgacgatacacatatcgatcagttcgttacgtgccattagcgtttctacgacacggacggtaccgttgataaaggggccttcttcatcagaagtgatcaaaaaaccgattgagccttgatgatcgggatgttcggcaataaaacgctctaccgccacaatcatacaagccagcgagcctttcatatctgctgcgccacgcccatgcaggaaaccatcaatcacagtcggctcaaaaggaggagtgtgccactgcgacaaagggccggcaggcaccacatcggtatgacctgcaaaaacaaacaggggagattgcgtgccgcggcgagcccagaagttggtggtgtcttcaaacaccatgctttcaatttcgaaacccagcgcttttaagcgctcaatcatcagatcctgacatcctgcgtcggcaggagtaacggattggcggctaatcagctcttttgccagagccagtacagggctatctgtcatccttgaaattccttttattaatcaaaacgcttaagaaaaaagagcgcgatactgggcatcgctaaagccaagatgcagttcatcttgacgttgtaaaatagggcgcttaatcatcgccggatgttctactaacaatgccactgcattgtcggcattcaaagtggctttttgctcatcactcagttggcgaaaggttgtgccgcgcttattgagtacttgttcccaacctaattggctacaaaatccagccaccaattctggggtaatgccctctttgcgatagtcatgaaactggtaggcgacgcccgcttgttctagccatttacgggcttttttcatggtgtcgcagttcggaatgccatacaaagtgatcgtcatgtttatccttaaatgggttttattgaaggcctgaatgggttgcttcatggtgttgagcttagggcaaccttgcttattgtgcgttcaatcctaacaggaaggttcggccgagacaaaagtgtgatgtagatatttcacgcacggaaaaaatagcctactaaagtaaatcgattggcaagttattgatcaaacgcaacacatcacacagtaaaacggaaataatgagcacagcatactttaggaggtatcaatggaactgagtcctgtattcgcaaggcgcttatatttagctttgcttgtggagagccttgagcgacccaatgtccctaaactgattgaaaagacgggctggcctcgtcgtactatccaagatgtcatcaaagccatgccgggtatcggtattgaactgaacttcgtgcaagatggccgccgacacaatgatggctactaccagctttctgactggggtccctttgacagccaatgggtcaccgaacgcaaaaaagacattgcggcaagcttagggttttgtgcttaaagccagcatcgctggctttttcattttccacattatgcggcttggcacatcatgcggcttggtgcgtcagctgttttgccacaaccagtaactgataaaacctaaccaacttagcgctaataatacccatgcgagtttggcttgattggtatgagagtcatcgccgagttcggctgcatagtcatccgcttcgtggatttcctctgtcgaagattgcttggcttttaacgcttttttacgcagcttatctgcctgccggtgtttctctttctgctgctttttgtataaagcaatccctttttcgataccttgagtgatgagcttagtttgctctttggtttgtccggggcgctgagtcgctttcgcaatttttaacgcctcttgctgggtttgttctgacggaatgagagtcgtgtttttcattaatctatacggtttaaaaagcttaggactaagactagcatgtgagcgcagggtaaaaaatggggcgagctaagaataagcagtggtcatttaggggaattgcgctagagtgaacagcctgtgttttatgagttgagaaaaccgtgcgttattcgattgaacagtatgatagtcaaggatttttaaaagcaccgatatggctatggctaggatggctgtttcttaatcgagcttgggtcatgtttgtgatggcgggggtgagccgcgaacaaggttcccatttgctctcattgatctatcccgatcactctttgttgtatgttggacttgcgatgggggctccggctcttgccttaatgtggctcatcacattacgcagttcgcagcggcaatgggtcaatcagattgtcgcgcaaggtcgtgcgatttctttattcgttgtgataggccaatttgtgcaaacggcttttcacgtttacttgcagcagggggcttttcactgggccaacgcattgaccctactcttattactgtggtttggcatttaccttgtgcagagtcgccatgtacgcgacagtttaaaagcccccgcgttggataaggcatgatcatcatcaacgcgatgatttttctttttattacactgagcaaaaccgaaaagtgaggattcgttatgtttaagtcacagaccgcaatcttgccagaagctggcccgtttgccctgtacacactactgaaagttcgtcagaaccacgcccatgttttgcaagcgcttaaggctttgcctgcgttagttgaggaaatcaatcaaaatcagccgggagccgagctgacggtttctgtcgcgttcagcaaaggtttttggagccattttgagatggcgtcgccaccagaactgattgattttcctgagctgggtgagggcgaaactcacgcgccaagcacggatgtggatgtgttgatccattgtcacgccacgcgccacgatttgctgttttatactctacgtaaagggattagcgacatagctcaagatattgaaatcgtggatgaaacctatggtttccgttatttagacgcacgtgacatgacgggctttattgatggcacagaaaacccgaaagctgagaaacgtgcggaagtcgcgttggtggctgatggcgactttgcgggaggcagttatgtgatggtacaacgctttgtgcataatttgccggcgtggaatcgtctcaacttagcggcgcaagaaaaagtgattggtcgcactaagcctgattccgtcgagctagaaaatgttcctgccgcttcgcatgtaggtcgagtggatattaaagaagaaggtaaaggattgaagattgttcgccacagtttgccgtatggcagcgtgagcggcgatcacggcctactgtttattgcgtactgtcacacgctgcataatttcaaaactatgctggaaagcatgtacggtgtcactgatggcaaaacagaccaactgctacgctttaccaaagccgtgaccggggcttatttctttgcaccgtcgcaagtgatgttgcaggaactgacactcaagaatcaataatgcaacactgttgcatatgtttcatgccaaagccgagcctagtgctcggttttttgattaaagaaaactcactttacaccgataaaagaacaagtaagcaatcgtgtaaggagtgcagcagccatggccatgttgggataaccctatgagcggtattgagctagtaagtaacttgtggtttaaatgttacttataaggtggaagggagattgttatggaaataccatcctacgcatcgaacatccagccttacggctcacaaagtggcactaaaattgcttcagaaaacgataatgcaaaaagcgtttcgctttcaggggataacagccgctcggtttcgcgtacagataaattatctgaacacttttctgagcaggtcagggcaaggcagcaagaatcggcagagacggccatggcgcaagcaaaacagcgccaacgtcttaacgaggagcaacttgccaagatggtggagcaaatgaatgagtttgtgaaatccattaacaaaggcctgtctttcagattggatcgtgaatccgggcgcgaggtggttactatctacgaagcctcgacgggtgatattattcgccaaatccccgaggaagagatgcttgaagtattgcgccgccttgcccgtgaacaggatcatcgatccggtttactgatggcaaaggtgtaacacggtttttgaggtgattgaatgagtttaggcccgatggggatgaatactggctttgacatcaatggcatggtcagcaaaattgtcagtgcggagcgcgtacctaagcagcaacgcattgacaatgagcgtaccaacattgacaccagtatcagcgcctatggtcggctcagagagtcgctggatacgatgaaaaatctgatgacccagtttcgtcaggagaaggcttttgcagtacgcaaagtcgacaccagtaacgaacaggttgtctccgcggcggccaccacggaagctattgctggcaactactccgtcgatgtgttgcagcttgctcaaagccataaaattgcgtctgaagtattggacaaagacgcgaaatttggtccgggcaagctgcatatttcattgggcgataagagttttacgctggatgtgcaaggtaactccaagctggttgatattgtccgtggaatcaatggtgaaaaatccaatccgggcgtgcgagcctccatcatcaatgatgttgaagggccgcggctgatcgttgcctctaacgtgtcaggcaaagatcacagcgtaaaaatgtccgctcaagcggaacccggtaatccacttaagcaactcgaatacaaaaccctcgaacagcgagttcgtgatttagaaaaagcgcgtgcgcaagctcagcaactcatcgccccactcacccctgaacagcaaaaagtcgccgccaaagtcgcggaaaaaattggcgatgctgctcggctggtcgatcaagaagtcgcacaagaaattcgaagtgccgcacaaagtgcacaaggtgcggccggagaggcgctcaacgctggtgagttaaccgagagtgcggtaaaagccgcggctaacgccgccagtgaagccaaaaaatacatcaggccggaagaccgaattccgggctggacagaaaccgcgtccggtaccttgctcgattcctattgggaaccggaagaagaactcgacgctcaaggtcaaaaaaaggccgctgacgttcccggatggagcaacaccgcatccggtacactgcttgattcctacgtcacgccgcaagaagcgcagcaaaagctagaacagaaattagcgcaagagaaggcgcagattgaagcggcgatccgcagcggaaaaatgacgccagaagaggccaaagcccaagcgcgcgcgaaacttagcccagaagagcgtgcctacattgaacaggtcgaaaaagcgcaagcagccttgaatgcggcgcaaagtgcctttgatggctacggcggcatgaccgaagtgcaatcggcgcaagactctatggtggtgctggatggggtggcgaccttatcgagcaataacaacatcatcgaaaatgcgatcgaaggggttaacttaaccctcaaaggcaaaaccgatcgcaatcagcctcccgcggaaatcggcattgaatatgaccgcgaacgagtgcgtaacgacattgaacagtttgtcgcggcctataatcagtttttccaaaccagtaaagagctcgcgggtgttgatccacgaaccggacaagccggtcctttagcgggtgacagcatagttcgtagcgcagactcacgattaaaaacggtcttctcatcgagcattgagcaagcgccagaaaacctcaaatcactgactgagtttgggatcaccaccacccgacaagggacgctagaaatcaactatgctatgcttgaccgccaattgaataacaacttcactaagttgggtgagttttttggcggcaatcaaggctttgctaagcgggtcgaagatgcgatttcgagcatgactggggttacgggttcaatccgtacccgagaaaagagcttgaatgaacagacttaccgattggatgacgaccaacgttctctcgaccgccggatggagagtttggaaaaacggacccatgcgaaattcagtgccatgcaagatgcgaccagcaagatgcaatcgcagttagcgggcatgatgaacgctttaggtggttaatgtggaagcagaactgcaacgtttgagtgatctcgatcaacaaatcgcaactcttcttgcggaagatgacattcatactgaagatattttgcagttggtcgataacagggaacagctattgcatagcttgttaggctatttggccgagcaccctgaattggcaaagtccgatttatggctcaaggcaattggtaatactcaacaacttgtggaacagatgcagttaaaaacggcggcgatggggcaaacactccacaaatatcgtcacggaaataaatcggttcagcaatacaaaaagtttttataagaggaagactatgcgtggttctttacaggcgtacaaaaaagtatcagtggatagccagctaagtgcggcctcaccgcataaaatcgtccagatgttaatggccggagcgattgagcgcctgatccaaggtaaggcggcaatgcagcaaggtaacatccctgtgaaaggcgaacgtttaggtaaagccttggatatcatcattagcctacgcagctgcttgtcgatggaagacggtggcgacatcgccaaaaatctcgatcaactgtatgactttatggtcaaccaaattactcaagcgaaccataaaaatgatccgcaaatgctcgatgatgtgattgagatcatccgtgaaataaagtcagcttgggatcaaattccaccggaatatcacaacttgactgccgctgaagtgggtatttgatttctgtcagagaaacttttaacagatatcacacccagcaaatgcttggttgccttatttgctgatttaaatagaatagaagccactaactagccaagtggctttttttgttgctgatttccacaaattgtctatcgtttattcaggatccagaatcaaaattaacacctgaaaatgatgttcaaacggtgcaaccacaacttcttataataaaggcaaataatctcacctatgcagagtttagcgaaactacttgtgattgaggacgatgccgcgatccggctcaatctcagtgttattttagaatttgtaggagagcagtgtgaggtcattgagtctactcagattgaccaaatcaattggtcggcagtgtggggtgggtgcattttaggctcgctacgtggtcaagcgctttctgaacaattaatccaatctttaaccaaggctaaccatatcccgttgctggttgccaataagcagccttattccttagaagaattccccaactatgtgggtgagttagattttccgctcaactatccgcagctgagcgatgctttgcgtcactgtaaagaatttcttgggcgcaaaggttttcaagtccttgcgaccgcacgcaaaaacaccctgtttcgtagccttgttgggcaaagcatggggattcaagaagttcgccacttgattgagcaagtctcgaccacggaagccaacgtgctgatcctcggtgagtcgggcacgggtaaagaagtggttgcgcgtaacattcactaccattcaggacgccgtaatggcccttttgtccccatcaactgtggtgcaatcccggctgaattgctggaaagtgaactgtttggtcatgaaaaaggggcgtttaccggagcgattaccgcacgtaaaggccgttttgaactggctgaaggcggcacactctttttagatgaaattggcgatatgccgatgagcatgcaggttaaactgctgcgcgtgctgcaagagcgctgttttgaacgggtgggaggcaacagcaccatcaaagcgaatgtgcgcgtgattgccgcaacgcaccgtaatttggaagagatgattgacggacagaaatttcgtgaagatctctactaccgcttaaacgtgttcccgattgaaatgcccgctctgcgcgatcggattgatgacattcctttgctgttacaagagctgatgactcgtatggaagcggaaggggcgcagcccatctgtttcacgccgcgtgcgatcaattcgatgatggagcatgactggccgggtaatgtgcgtgaacttgccaacttggttgagcgtatggtcatcctgtatccaaacagtttggtcgatgtgaatcacctgccgaccaaataccgttacagtgatattccggaattccagccagagcctagccgttttagctcggttgaagagcaagagcgtgatgtgttggaaggcatttttgcagaagactttaattttgaagagccgcaggagtttgtccctgatatagatgcgccgcaagcgctgccacctgaaggggtgaatctcaaagagttgctcgctgatttagaagtgaacctcatcaaccaagcgttagaagcgcaagggggggtagtggcgagagcggcagacatgctcggtatgcgtcgcaccaccttggttgagaagatgcgcaaatacaacatgcaacgctagggaaaccatagtcaatatattggcattaattaacgtgttgattttaaacatgaatggcttggcatgactcttgcgtgccaagccattgttgcatttaaaaacagagagtgaatgatgagcagcgcagtgcaagagcagcattcccatttggactcgttagaagatcaagttgagcgctataaacaggtattggatgtgatgcccgccggggtgattttgctcgatacccaaggcatagtgcgtgaagccaacccagaagcgcagcgtttactggatgtaccactcgtgggtgaaaaatggtacagcgtgatccagattgcttttgccccgcgtgacgatgatggtcatgaaatctcgctgcgcaatggacgcaaagtgcgcttggcgatctccgcctcgacaacgggtcagctcattttgattaccgacttaacggaaactcgcctattgcagtcacggatcagtgatctgcaacgtctctcttccttgggacgcatggtggcgtcattggctcaccaagtgagaacgccactgtccagtgccatgctgtatgccgcaaatctcgcagcaccgaatttaccgcctgctactcgtgagcgttttcaaagtaagttggttgaccgactgcacgatttggaaaagcaagtaaacgacatgctgctttttgccaaaggtggcgataacaaggtggtgatgcccttctcgattggcgatttggccgccgaatttatgcctatggtcgaaacggcgctgaaaaataatcagatcgattacggtcaagaagtcgaaagtgaagagaccatgttgctgggtaatgccaatgctttggcttccgcgctgagtaatttggtgatgaatgcgctgcaaattgcggggaaaggttcacaaattgatgtgtttttccgcccagtgaatggcgaacttaaaatttccgtgcaagataacggccccggtgtgccagagtcgttgcagcacaaaatcatggaaccctttttcaccactcgctcacaaggtacaggccttggcttagcagtagtgcagatggtgtgtcgcgcccacggtgggcgattggaactgatatccaaggagggagagggcgcttgttttaccatgtgcattccccttgaacgtcaggcagatagctcaaactcagagactggagagtgaagatggctcaaagcaaagtcttaatcgtagaagatgacgaaggtcttcgcgaagcgttgatcgacaccttagctttagcgggttatgagtggctggaagccgattgtgcagaagatgccctgctcaaactcaaatcacacagtgtcgatattgtggtgtctgatgtgcaaatggcaggcatggggggactcgctctgctgcgcagtatcaaacagcactggccgaatttacccgtactgctgatgaccgcttacgccaatattcaagatgccgtatctgccatgaaagatggcgcgattgactacatggctaagccttttgcaccagaagtgctgctgaatatggtcagccgttacgcaccagtaaagtcagatgacaacggcgatgctgtggtcgcggatacgaaaagcctcaagctgcttgccttagccgataaagtggcgaagaccgatgccaacgtgatgattttggggccaagcggctcaggtaaagaagtgatgtcacgttacatccacaatgcctctcctcgtaaagaggggccatttattgcgattaactgcgcggcaattcctgacaacatgttagaagcaaccctattcggttatgaaaaaggcgcgtttaccggagccgtacaagcgtgtcccggtaagtttgaacaagcccaaggtggcaccattttgctcgatgagatcagcgaaatggatctgaatctgcaagcgaaactgctgcgggtactgcaagagcgtgaagtagagcgcttagggagccgcaaaagcatcaagctcgatgttcgcgtgctcgcaaccagtaaccgtgacttgaaacagtatgtgcaagccggacatttccgtgaagacttgtactaccgtttgaatgtgttcccattaacctggccagccttatgtgagcgtaaagacgatattgagccgctggctaaccatctgattgagcgtcactgcaaaaagttaggtttacctgtaccaagcattgcgcctaacgccattactaaactgctgaattacccatggccgggtaatgtgcgtgagctggataacgtcgtgcagcgtgctttgatcttaagtgaaaacggccatattcaaagtgagcacattttgctggaaggggttgattggcatgatgccagcagcttacagcaagcggtggcgggagagtcgatggctgcgccgcagatcaaacctgttgcagagcccgaagtgtttaagcccttagtgcaaggtggtgggcaaaacagtagttcgcaaagttcaggtttgggtggtgagctgcgcgaccaagagtttgcgattattcttgatacgttggccgaatgtcagggacgccgtaaagagatggcggagaagctaggtattagcccacgcactttacgttacaaactcgccaaaatgcgtgatgcagggattgatatccccggttgagggcatggcatacaaattgctctttagagttaggaatggaatttttgagtcaaacaattggcatcagaggtagcaatgagacttgacggtttaaataacgaaatgcaggcgatgatgtttgaggcaatgaatactcagcccgcatcgacaggtcagaaagttggcgctgactttggtgccatgttgaccaaagcgatcaacaacgtcaatggcctgcaaaagacctcaagtgatatgcagacgcgttttgatcgtggcgatgaaggaatttctctttctgatgtgatgatcgcccgtaataaatcgagtgtggcgtttgaagcgaccattcaagtacgcaataagctcgtcgaagcgtacaaagaactgatgaatatgccagtataacttgggtaatagactgtggccgatgataaacaaacaaccgatctcgcgttgaccaatagtggtggtgagcatgccttgatggcaggctctgatatggaccacgacacgcagaatccggacatcaacgaaaaaagtagcaaaatggactttaccgttggtgatctcgatttattgcgccaagtggtactggtactgtctatttcaatctgcgttgcccttatcgtcatgctgttcttctgggtacgtgagccggatatgcgtccgctgggtgcttacgaaaccgaagaactgatcccagtcttggattacctcgatcaacagaaacagcaatacaaacttgatggcaataccattttggtgcccgtcagtgattacaacagcctcaaactctccatggtacgcgcgggattaaaccaaaaccgtcaggctggcgacgagattctgatgcaggatatgggctttggggtatcacagcgtcttgaacaagaacgcctcaagctgagccgtgaacgtcaactcgcgaaagcgattgaagagatgcgccaagttaacaaagctcgcgtattgcttgcattgccaaagcagagtgtgtttgttcgtcataaccaagaagcgtcagcgtctgtgttcttgacggtacgcacgggagccaatcttaaacaagaagagattgatgccgtggtcgatatggtggccagtgctgtgccgggcatgaaaccgagccgggttacggtgaccgatcagcatggtcgtttgctcagctcaggctctcaagatcccgtttctgcagctcgccgtaaagagcaagagctggagaaacaacaagaagaagccctgcgtggaaaaattgactctgtgctgatcccgatccttggtttaggtaattacaccgcgcaggtggatatcgaactcgatttcagtgcagtagagcagacacgtaaagtgtttgaccccaacacgccagccacacgcagtgaatacacactggaagattacaataacggtaacgttgtcgcaggggtgccgggcgctcttagcaaccaacctcccgccgatgcctcaattccgcaagatgtagcacagatgaaagatggctcggtcatggggcaagggtcggtgcataaagaagcgacacgtaactatgaacttgataccaccatcagccatgagcgtaagcaatcaggggtgattaaccgtcagactgtagcggtggccgtcaagagtcgttccagcgtcaatcctgatactggcgaagtcacttacacgccactcagtgaagcggacctcaactcaattcgtcaggttctgatcggcaccgtaggctatagtgaaaatcgtggagatttactgaatgtcctcagcatgccgtttgctgaacccgaaatggaacaaattgttgatgtcccaatttgggaacatccaaacttcaacgattgggttcgttggttcgccagtgccttggttatcatcatcgtcattttggtgctagtacgcccagcgatgaagaaacttatcaacccagcggcggataacgatgaccaaatgtacggcccagacggtatgccaattggcgcggatggtgagacaagcctcatcggcagcgatattgatggcggtgagttgttcgaatttggttcaggcattgatctgccgaatcttcacaaggatgaggacgtgctgaaagcagtacgtgccttggtggcaaacgagccagaactcgcggctcaagtagtgaagaactggatgcaaaatggctaaagacaataaagatggtggagaagtggtcgaatcaaccattgatatcagtgaaattcccggtgaagaaaaagcagccattttgctgctcagtttgaatgaagaagatgccgcaggcatcattcgccacctcgagcctaaacaggtacagagggtgggtagtgccatggcacgcgccaaagacttaagccaaaccaaagtgtcagcggtgcatcgtgcctttttggaagatattcaaaaatacaccaacattggtatgggcagtgaagacttcctacgtaatgctctggttgcggcgttgggggcggataaagccaacaacttggtggatcaaattctgcttggtaccggctcgaaaggtctggattcactaaaatggatggatccacgtcaagtagcgagcattattatcaacgagcacccgcagatccaaaccatcgtattgtcgtaccttgagccggatcaatcggccgagattttggcgcagtttgctcagcgtgacgctctcgatttgttgatgcgtatcgccaacttggaagaagtacagccttcagcgctggccgagttgaacgaaatcatggagaaacagttcgcgggtcaagcgggggcacaagcggccaaaattggtggcttgaaagctgctgccgacatcatgaactatctggacaacaacatcgaaagcgtattgatggaaggaatgcgcgaaaaagacgaagacttggcaactcagatccaagatttgatgtttgtgttcgagaacttagtcgaagtcgacgatcaaggcatccaaaaattgctgcgtgatgttccgcaagatgtcttgcaaaaagccctcaaaggggcagacgatacactgcgcgagaagatcttcaagaacatgtcgaaacgtgctgctgagatgatgaaagacgatttggaggcgatgccaccgatcaaagtgtccgatgtggaagcggctcagaaagagatcttgtctatcgctcgtcgtatggccgacaacggcgagatcatgctgggcggcggtgccgacgaattcttataatcaagtaggatcggtgtaagccgatcctatttccttcgatgcattattttgatgaacgttaaacaaaacttgctgcatgattgaggatcacaatgtctggtgaaagaaagcgtggttttattcgcccgggtacagatgatgcgacggtcacacctcaacgttgggggctgccggattacggtgcggaaagtaacaaagcggctaaacagactgcgtttaattacgatccgggctggatcccaaactttgacgaaccggagcaggtcgtcgagcacgaattcagtgaagaagagattgcactgatccgcactgccgctcaacaagagggctttgaggcggggcaagcagaaggctatcagcaaggctttgaacaaggtaaggctgaaggtttccaagctggtcatcaagaagggcaaacgcaaggttatcaagatggcgttgccgaagggcaagccttaattcaagaacaagtcaaaacctttatggcgctggcgaaccagtttgctcagccccttgatctgcttaatgctcaggtcgaaaagcagctggtggacatggtactcgcgttgaccaaagaagtggtgcacgttgaagtgcaaaccaacccacaagtgatcctcgataccgtcaaagcttcagtcgaagcgctgccgattgcagggcacgcgattactctcaaactcaatccagaagatgtggagattattcgccaagcctacggtgagcaagaaatcgaaacccgtaactggactctactcagcgagccagccttaagtcgcggcgatgtacagattgaagcgggcgagtcgagcgtcagctatcggatggaagagcggatccgcagcgtgctgaaaagcttctgcggtatcaaccgtcaccatccgggagagtagccgatgttagcgttagctgatcgccttgcccaatacaaagtcgaaggacacaccacccgacccatggcttcgggaaagttggtgcgtgttgtgggtttgacgctggaagccacaggttgtaaagcacccgtcggaagtttgtgtaaagtcgaaaccatgaacggcgagatggaagccgaagtggtgggcttttctggcgataacctctttttgatgcctagtgaacagatcatcggtgtccttcccggagccaaagtgactcctatcacgaccgaatcaggcctgcctgtcggtatggaactgctgggacgcgtgattgatggcgtgggtaatccgctcgatggtttaggtccgatttataccgatcaacgcgcttcacttaacgctataccgattaacccactggcacgtaaaccgatcaacgaacctttggatgttggcatcaaggcgattaacggtttactgacggtcggtaaaggacaacggattggcttgtttgccggttccggtgtcggtaaatcggtcacgctcggcatgatgacccgaggcactacagcgcaagtcgtggtggttgggttgattggtgagcggggacgtgaagtcaaagaatttatcgaggagatcctcggcgtagatggtcgccagcgttccgtggtggttgccgctcctgctgattcctcgccgctgatgcgtttaaaagggtgccaaacggctctgactattgccgagtattttcgcgatcaaggtttggatgtgctgctgttgatggattcactcacgcgttttgcgcaagcgcagcgtgagatagctctgtccgttggagagcccccggcgaccaaaggttatccaccatcggtgtttgccaaactgccggcactggttgagcgcgctggtaatggcggcccacaccaaggttcgatcaccgcatttttcaccgtattgaccgaaggggatgacttacaagatccgattgcggatgcctcgcgcgcgatcttggatggtcatatcgtgttatcgcgggaaatggccgatgcagggcactatccggcgattgatgtcgaaaaatccgtcagccgggttatgccacaaatcaccaccgatgagcatttactgatgtcgaaagcggttcgacagatcctttccgtgtgtcgtaaaaatcaagacttagtctcgattggtgcctacaaaccgggcaccgacaaagcgattgatgcggctttcaccctcaaaccgaaattggatcagtacttgcagcaagccatgaaagaaaccgtgccttatgacatgtgcgtcaacatgctgcgccatgtactcagctcataacttggagcattgaaatggataacgcgttagatttcttgctcgaacaagctcaggaaagcgaagacaaagcggtgttggcgctcagtaaagcacgcagtgagctggatagttactaccaccaactgcgtcaaattgaacagtaccgcttagagtattgtcagcagttagttgaacgcggcaaatcagggttaaccgccagccaatatggccacctcaaccgatttctcactcagctcgatgaaaccttagccaaacaaaaaagcgctgagcagcattttcgtctgcaagttgaaaactgcgaacagcactggatgaacatgcgtcaaaaacggaaatcctatcaatggctgatggagaaaaaacaaaccgaacgtcagttattacaagaaaaacgcgaacagaaacagatggatgaattttcgaccctgatgttcaatcgccgccgtctctcctcataaggcgtagtttaaacgtcgtatcacggcgcgagcttctcctccttggatgcaataaaaccttcacttggcttacttcttgctagattttcgcaaaagggcgttaaccccaagctgttactgatgagttgatctgcgcaggtcatgctcagacttcaattccactgtgcgagtagcgaatatgaatgtgaatctcacccctccggttgaaccgagtaaaatagctccaacggcaaaaagtagcgcagtcagtacggatgccgctgcgacggagtcctctggtggtttttttgcgcagttacacgctcttattttcggcagcaaaaccgcttcagatgcccccgctaccagtgtgactcagactgaaggtgacaccgaagcgccagtgaatacagaggcagtcctagaggctgatagtgatgccgctttaatggcagagatggatgacgccttgtttagcgccagcgaagtggaggcggccagtgaagaaggcttgccagtcgatgtcataaaatccgctcagaaagcgccatcattagaaaaaggtgaagcgatttccaccaaagtggcaccagtcaagcaagatgaacaaggtgcaaatgcgcccataccggcttcgctcgccaaatgggtcacgaatgcggagtccatcgatgaccagcctgtaagtggtgagttacaacgcaaaactgcacaggcgatgagtgagggggatgaattattggggcgtttgcaagaggcgaaccaagcgctcatcaaaaccaacggcaaaattttgccagcgcagcatggtcaagcattggactcacaacatcccgacagaatacggaacgcgacgccgcctgaagcggttttaccgattgaatctgccacggcaatctccaatcgtgctctttctaccagtgctgaccttgatgctgccgtctcagactcggctgccactgaagatgaaatagcacaagatgaatggatggcgagcgctctgatgggcggcgcattagtaggcggattgtcaggtgcttcattggcggcggcaaacactgtgcacgctgaaccggttgagggggcaatgcttgagggaatgccgctgacacagactttcgctaataccgcggctttggcaagcccaagcgccgaagtgagtgaggctcttgcggcttcaagtcaagcgctgaaagcgacgccattgactcaatcagcgctcaatcctgcatcaatcatggctgatgaagggcttaatcagtcaacttctgcaacagaaacgggcaaagtggtgattccttggggcacacaaatgccgactgacaatgagttggctgcgctgacaccagagctgaaagccatgctcgaagaagggggtaaagcgaaagcgcctgttcctaatgcgctggctcagtcagtcgcacaagggttaacgccagcccatttagcggcgcagcaaacgggcaccacggcgctgccaatgaatcccacggcggcgacgcctatcgatatagcggcactagcgcctcaaaccgtagcggtcaatccaatgttaaatcctgccgcgacggtgaatcctgagcttgccgccagctctgccatgctggcagcattaggtggccgagctttagcgggcagtgacgaacgtcgtgcggtcagtgaatcaggacaagaagacttagcccagcaaatcgcagcggcagcaggacaaggtacggcgcaaaaccaagctctcaaccgcgctgagtcgcaactggtacaaaccaatgctacccctgttccattgaataaagagatggctgccgatcagttggctgaacgtgtgcagatgatgatgtcgaagaacttgaaaaatattgatattcggctggatccaccggaattgggacggatgcatattcgcatgaacatgcaaggtgatggcgcgaccgtgcatttcaccgtcgcgaaccaacacgcacgtgaggcattagaacaaaccatgccaaggctgcgtgaaatgttggcgcagcaaggcgtccaattgggcgatacctcggttcagcagcaaagtgcgggacaacagcagcgttatacaggacaagagcagtctggttttggtcaaagcgcacgcaatgaaaggctcaatagcgaagaaaaccttgatactgacatcaaacttgatttgaatgtggcaacaaagcgtgatggaatcagttattacgcttaaacttatacaaaattaaccacatacagaggcaattatggccgaagaagatctaggaacagaagctcccaaagggaaaaagaaactgttgatcatcattatcgccgccgtggtgttactggctggcggtggtggtgccgcatttttcatgatggggtcaggtggcgacgaagcggctgcggacgcagagcagaaaaccgaacaggtcgccgctccgaccgatccggtgtcttacgtcaatattgctcagccgtttgtgtttaatgtcactggggatgccaaagatcgcttagtgcaaatcaaagtccaattaatggtgcgtggcagcgaaaatgaaaaccttgcacgttaccactcgcctttagtggaaagctcgctgctggcgacttttgcatcagcaacggtggagcaattgcgtacccccaatggccgcattgagctgcgtgataaagccaccgatgacatcaaagccgcgctcaaccaagcggtaggcaaacccgttattgaaaaagtgctgtttaccgactttgtaatgcaataggtgaaatgtgactgatttattaagccaagacgaaatcgatgcgctgcttcatggcgttgacagcgtcgatgaggaagaagaggaattacccaaatctggccccagtgccacgaattttgatttttcttcccaagatcgtatcgtccggggtcgaatgccgactctggagcttatcaatgaacgttttgctcgccatctgcgcatcagtctgttcaacatgctgcgtaaaaccgcagaagtgtcgatcaacggcgtgcagatgatgaagtttggtgaataccaaaataccttatatgttcctaccagtttgaacatggtgcgttttcgtccacttaaggggacggccttggtgaccatggaagcgcgtttggtgttcattctggtggaaaacttcttcggcggcgatggccgttatcatgcccgaattgagggacgtgaatttaccccaactgaacggcgggttattcaactgctgctcaaaatcgtgtttgccgactacaaagaagcgtggtcgcccgtcatgggggtcgagtttgaatacctcgattccgaagtgaacccgagcatggcgaacatcgtcagcccaaccgaagtgattgtcgtcagctccttccacgttgaagtggatggtggcggtggcgatttccacatggttatgccgtattcgatggtagaaccgatccgtgaactgctggatgcgggtgtacagtcggacaaaatggaaaccgacgtgcgctggagtacggctctgcgcgaagagatcatggatgtaccagtcaatttccgagtgaacttactggaaatggatattgcgctgcgggatttgatggagttgcaagtgggggatgtcatcccgataaaaatgccagaacatgcggtaatgtttgtcgaagagctgccaacgtatcgtgtgaaaatgggacgctccggtgaaaaactcgcagtacaagtttctgagaaaatcaaacgcccagatgtagtgaaaacggatctcgcgttccttggtaaagacattattgctgagtttgaaaacgcagaagaagatgaaatcgaataatccgttttacgacgtcgggatgatcgctcgatagcggcggataatgaaaagaaccaataggtagttgaagatggcaaaaagcgaagatgaaagactggccgaagaatgggctgccgcactgggggaagaccctaatgcgcctgatattgatgtggatgaaatcttagccgcaccacttgaagagctgaaaaacacggcgcccccaattacggatgacgagcgccgtaagctcgataccattatggatattccggtgaccatctcgatggaagtcgggcgctctaaaatcagcattcgtaacctgctgcaattgaaccaaggttcggtggtggagttggatcggattgccggtgagtcactcgatgtgatggttaacggcacgctgattgcgcatggcgaagtggtggtggtgaacgataagtttggtatccgcctcaccgacgtgataagtcaaaccgaacgtatcaagaaattgagatagccaatgcgaaaattggcggctctgtttctcatccctgtccccgggttggctgctaccagcagccaactggatttagcgaccaccttggggtcgcttttgttcgttatcgctctgatactgctactggcttggttactcaaacgcatgcgtgtgcctgctttcggtcagcaaaaagggctgagtatcatcaaacagttacccgttggcacccgagagcgggtgatgatcatccaagtgggcgaagagcagtatttgattggggtgaccactcagtcaattcaactgctggccaaactcgataatccactcatacaggaggagctgccggcaaccgccttttctaaccagttgatgcagctactgaaaaaacatgaaacggactcaaagacttaatttaacctcttggttgacgacaggattactcacttggctgctttcggggttgcttggttttacctcgctcgcttttgcagaagagccactgaataccgcaattccatccaccgctgccggagcttcctctgtcactgtgacggcgctagaaaaagagcaggggaatgccaaaactatcgcgttaggcagtagcagtggtggcggtggaattccggcatttactatgaccaccaattccgatggcagcgaagattactcgataaacctgcagattctggcactgatgaccatgctcggctttttgcctgccatggtgattttaatgacctcattcacccgcatcgtggtggtgatgtctattctgcgtcaagcaatgggtttgcaacaaacgccgtctaaccaagtgattatcggtattgcgctgtttctgacctttttcattatggcgccagtatttaaccagattaatgaacaagcggtgcagccttatctcaatgagcagatcaccgcacgccaagcgtttgatttagcgcaagagccactcaaagcctttatgctcaagcagacccgagtcaacgatctcgaaacttttgtggaaatgtccggtgcacaagtgaccgcacctgagcaagtgtcgatggcggtactgatccctgcttttattacctctgagttaaaaacggccttccaaatcggctttatgctgtttttgccttttttgatcattgacttagttgtggcctcagtgctcatggccatgggtatgatgatgctttcgcccatgattgtctctttaccgtttaaattgatgttgttcgtgttggtggatggttggaaccttatcctgtcgaccttggcgggcagttttgccttgtagcggggagggcacatgacaccagagatatttgttgagctgtttaaagagtcactctggctggtactgatcatggtgtgtgccatcatcattcctagcttattggtgggtttggtcgtcgccatttttcaggcggccacctcgattaacgaacagacgctgagctttttgcctcgtcttatcattaccttattagcactgatgttttttgggcactggatgacacaaatcctgatggactttttctacagcatgattgaacgcatgccgcaggttctgtactaggagtccttatggaatatcccgccagtgtcgtccttgatttcatcgccaactatttctggccgtatacccgaattgcggccatgttgatggtgatgacggtgactggcgcgcgctttgtgcctgctcgagtacgtctctacttagggttagcgctcacttttgcggtgatgcccgcaattcctgcggttccttccgatattgccttgctctcgctacaaggattcatgatcaccttcgaacagattgtgatcggtgtggcgatgggcatggtcacccagtttttggtgcaaatctttgtcatgctcggtcaaatcctcggtatgcaatcgagcttaggttttgcctccatggtcgaccccgctaacggacaaaatactccgctgctcggtcagctttttatgttactggccacgctgtttttccttgtcagtgatggccatttgaaaatgatccaactggtggtcttcagttttaaaagtttaccgattggcagcggctcactgacgacggtggattttcgtgagttagcgctgtggctcggtatcatgtttaaagcatcattggccgtctcactgtcgggcattattgcactgttaaccgtgaacctctcctttggggtaatgacacgtgcggcgcctcagctcaacattttctcgctcggtttttcgtttgcgctcttggtggggttattgctctgttggtacatcgtccacggtttgtacacccattacgatatttattggcaagaggcggaagagcaagtttgccgtctcattcgcttaaactgttaggaggctgatttggcagaatccgacggacaagaaaggactgaagaagccacgccccgaaggttgcagcaggccaaggaaaaaggccaagttgcgcgttcgaaggagttggcttctgtctcggtattggtagtaggtgcggtttccttgatgtggtttggcgagatcttggccaaaggattgatggtggccatgcagcgcctttttgagctaagccgtgaagagattttcgatcttggtaagctgtttgacatcattggtggctcactagtcaacctgctgttgcccttgctcatgatcctgagcaccttgtttatcgctgccttaatcggtgcggcgggggtcggtgggatcagtttttccgctgaagcggcgatgcctaagctgtcgaaaatgaatccgctcagtggcttaaagcgaatgtttggtatgcaaagctgggtcgagctgctcaaatccatcttgaaagtgttgctggtgtctggcgtcgctttttatctgattgaagcttcgcaaaaggatctgttccagctcagtcttgatgtgtatccgcaaaacatctttcatgcgctggatattctgctcaactttgtgttgctgatcagttgttcgttactggtggtggtggcgattgatattccattccagatttggcagcacgctgaacaactgaaaatgaccaaacaggaagtcaaagacgagtacaaagacaccgaaggtaaaccagaggtgaaagggcgcattcgtatgttgcaacgtgaagcggcgcagcgacgtatgatggctgcactgccacaggccgatgtcatcatcactaaccctgagcacttttcggtagcactgcgttataagcaaaacaccgataaagcgccggtggtgatagctaaaggtgtcgatcatatggcactcaagatccgtgaaatcgcgcgggaatatgacattgcgattgttcctgcaccgcccttagcacgcgccttgtaccacacgaccgagctggagcagcaaattccggatggcctattcgtggccgtcgctcaagtgttggcatttgtgttccagcttaaacagtatcgccgcaaaggtggtcagcgaccgaaactcaatgaggagaatatgccgatcccaccggatatgcgttactaaagatgcgctatttttcaggaatcgacagcagtaccagtagcgcgccatcaccgccaaactcaagtggggcttggtggaacgccagcacatcggggtgctgcgccaaccagagtgggacgttctgtttcaagatgtgcttgccaataccgtgctgcacacaagcacagtgcacattctcctttaggcagtaggcgatcatcgctcccaattcgcgttttgcttcttgctgagtcatgccgtgcatatccaaaaacacatcgggcacatacacaccgcggcggagccttttcacttcgtacttggagacatcactgcgcgcatagcgggtcggcccttcatcggtcagatgaggcataaactcgtcagaaaaatagaaatcattgtcggaggcttcacgctcggtacggcggatttctttttgcttgggatttctgtttggtgcgtggagtatggtatcctgacgcaacttttttacgccctttacttcgtcacgaaacagtgagaaatcgtcgtcaagattatctttatcgctcttgttatgggtaattcggtgatcgtttttgctcattagggtgacgtgtttttgttactgtaaatggatgacgcggtattgtagcgctttttggaggcaattttggataagattttcgttgaggaagcggtttctgaactgcataccttgcaagacatgattcgttggactgtgagtcgatttaacgctgcgaacctgttttatggtcaaggcacggacaacgcttgggatgaagcggtacaactcattctgccaacgctctatctgccgattgatgtgcctccgcatgtgctgagttcgcgcttaaccagcagcgagcgtttacgtgtggtagaacgcgtgatcaaacgcattaacgatcgtacccccgtggcgtatctgaccaacaaagcgtggttttgtggccttgagtttttcgttgactcgcgagtactggttccgcgttcgccgatcggagagctgatccaaaaccgctttgaaccttggttgacagaagagccaacccgcatcatggatctgtgtaccggcagcggttgtatcgcgattgcttgtgccaatgctttcccagaagcagaagtcgatgcgattgatatttcagtcgatgcgctgaacgtcgccgagcaaaacattcaagatcacggtctagaacagcaagttttccctatccgttccgatcttttccgtgatttgccacaagagcagtatgacctgattgtgaccaatccaccttatgtggatcaggaagatatggatagcttaccaagtgagttccgtcatgaacctgagctcggtcttgctgcgggcagtgatggcttgaaactggctcgccgtattctggctaatgccccactgtatctaaaagagaacgggattttggtgtgtgaggttggtaactccatggtgcatatgatggaacagtacccgcacatcccatttacgtggttagagtttgaaaatggcggtcacggcgtatttttgctgactcgtgaacagcttatcgactgtgcggcggattttgcgctgtacaaagattaatgatgacacgctgaatggatgccaacgccgacctttgagtcggcgttttttatggcatataaacagccgaaagaccttggacaaggtggtgaatagcaccattaggcgatgaaaacggtcgaatctggtcatttttaggactttacatcacaaagcattaacgccactatgaagccacgaagaacagttaatcagtgaaactggagtttcactgtgcattgaggaagtcatggcaggaaacagtatcggacaacatttccgagtcaccacattcggagaaagtcacggtatcgcactgggatgtattgtcgatggttgcccaccggggctcaccatcagcgaagcggatttacaagtggatcttgaccgtcgtcgccccggcacatcgcgttataccacccagcgtcgcgagccggatgaagtcaaaattctctctggtgtgtttgagggcaaaaccacaggcacatcgattgggctattgatcgaaaacactgaccaacgctctaaagattattcggatattaaagacaaattccgtcccggacatgcggactacacctatcatcaaaagtacggtgtgcgagattaccgtggcggcggccgttcatcggcacgtgaaaccgccatgcgtgttgcggcgggagcgattgccaaaaaatacctgcagcaagagtttggcattgaagtgcgtgcttacttgtcgcaaatgggggaggtcgcgattgataaagtggattggaatgagattgaaaacaacgatttcttctgccctgatgtcgataaagtggctgcgtttgacgagctgatccgcgagctgaaaaaagaaggcgattcgatcggcgccaaaatccaagtggttgctactggcgttccagttggcttgggtgagcctgtgtttgatcgcttagatgcggatattgcccatgccttgatgagcatcaacgccgtgaaaggagtcgagattggtgatggctttgatgtagtgcgccaaaaaggcagccaacatcgtgacccgctcactccacaaggtttccgctctaaccattccggtggcattttaggcggtatctctagcgggcaagatattgttgctaatattgcgttgaagccaacgtccagcattaccgtgccgggtgaaacaattgatgttaacggtgagccaaccgagcttatcaccaaaggtcgtcatgacccttgtgtggggattcgcgctgtaccgattgcagaagccatgttggcgattgtgctgatggatcatctgctgcgtcatcgtggtcagaaccaaggtgtcgtaacgacaacaccgaaaatttagtgatgcgctaacccctgtaaagagcccaacgccctcgattgagggcgttgtcatatccgcttaatttaccgccggggcaggctagtgaatggagttctcggtttctaaatggaaagagggcagacgccatttaaaacgcaccgcagccatccgcaaagtgtaaccgaccaccagagtgaccactgtgcttaccacatcactgacaccaaattcaagcaaggcgagatacagtcccgatgccaacagagcaatcgaggcgtacaactcttcatgcaataccaaaggtggttgacggcaaattaaatcgcgcagcaaaccaccaaacacgccagtgactaccgcagaaactaaacagatgccggggtgcagtcccatgcgcatcgccacttgcgtaccgatgatcgaaaacacaatcagccccagcgcatcaagacgaataaacaggcctttgagcttgatgacccacttatagacccaagtggtcagtacgcccgcgacacaagtaatcgccagatattcaggattctttacccagccgagtgggtagtggcccagcaaaatatcgcgcactgtaccaccgccaatcgcagtagcgctggcaaccagcatgacgccaaaccagtccattttgcgacggccggcactcaaggctccggtcatggcttccgccgtgatcccaatgatatacaaaacactcagcagcatgcatcacctcattcaacagcagaggatatatacccttcctacttgaagctgcagcggtgttggcggcgttcactttccctaatcgcttatctatgttcctagggatgaacttatgggccgtctacctacaacgccaagtagtttggtatagaaaaattaaggcgaaattctaggttttatcttaggcaataaacaatgattttttataaggtgaaggtgactttaattagtaaaactaatgtcttgctgatagttctcattccaattgattcctaatagaagccgatggtttgcggtttagctctttacccgatgagaaaaaatctccagaatgcacgccgtcacccatattgactatgtactatgaaccatcaataccaagacctcattgatattttcaatcagacgttttacgccgattacaacaccaagctggagttgggcggcgatgagcccatttatttaccggcggatgaacgagtcagttaccaccggattatttttgctcgtggcttttatgcttccgctttgcatgaaatcgctcactggtgtgtggctgggccgcagcggcgtctgcttgaagattttggttactggtatgagccggatggtcgtactgcacaagtgcaggcggaatttgaaaaagtggaaattcgtccgcaagcttatgagtggattttagccataagcgcaggctttccctttaccgtaagttgtgacaacctcaacggtgattttgagccagaccgtttggcttttatgagcaaggtacacagtgaagtgctcaagattcttgaacaaggtttaccgcagcgagtgaagatgttgtcggaggcgttacgcgctttttaccaaacgcccgccttgctgcctgaacactttgtggttaaataaccctaggtgaaaaccatttatccattaacgagaagctgatgattattgaatttgaagagaaactgctggatctgattgatgcacaagtcgttaacgcgtccagtgatgagctgtttgcgggtggctatttacgtggacacatttcactttctgcggcgcagtgtgaagaggaagggatcaccgaacttgatgtgctcaagcaacgcattgaacaaagtttagaggcggcgcgctcagagttgagccctgccgatcgcgcgattgtggctgagctttggcagcagctggccgcgcaggcgtaaccaaaccattcggtttgatcgcgaaagccactatcagtagggcaagcagtaggtcaaggctttcgcgatttcccacgttttcgctccactctccagtgctaaaagtcagttgttcaaactttctgaacaactaagtaaaaaaatcaggattgttgcgcatccatttcccgactaatcttgctttaacactagtcaggggaaaccaccatgaaaattattgccttcggtgccagcaccagctcaacatctattaataaagcgcttgccacttttaccgccaatcttgtcgatggcgcacaggtacaagtgctgaatatcaacgattactctgtacctatgttcagcgaagatctggaaaaagagatcggtcaggcggaaggagcccaagcctttttacgcgaccttgcacaagcagatgctttcgtgatttcgtttgctgagcacaatggtcactaccctgcggcgtacaaaaacctgttcgattgggcaactcgtatcaatcgcgctctgtttggtgataagccagcggtgtacctgtctacttctccaggccctggtggtgcgaagtccgtgcttgctgccgctaccgcttcagcgcctttctttgggggtaacgtaaaagcatcagtttcagtgcctagcttctacgataacttcgatctcgagcaaggggttgtgaccaagcctgagattgttgctgagctgaaagcggcggtggctaagctctccgcctaagaaaaaattgtccattaagtcctaaatgtcgaaagcctcgcactgcgaggcttttttgatcggcgttgattgcctttatcagactttttgtgtgagcgccttgcctttacgcagctttcgaacccacatccgactagggtgtaactgttcgagcaaatctacgcctagtggcatggggtcgccacacatttgcgaagcaagaagttctgccatcagcggcgcgctacttaaaccgcgtgagccaagcccgaccaacgcataaagttgcggatagagcgcgattggctcagcttggtgctgctgagctaaatcgcgatattgctcggtgattttcgaaaattcgccgacattgccgacaaaaggcagatgatcgcgactcacacagcgcacgccttggcgtgattgattgccgctgacatccacttccaatggccaagtttgctcaggcaagcagtgaattagcttttgtgcattttcgtgttgtgcttgcggatcaaaagtcgcatcaaggtgctggcgatcataacttgcgccaatacagtgatacccattttgttggctgaccggagtcatgtaaccgtcgtaacagagcacactgttgattttgctcagcgtctctgtggtcgggatgtggctcacttggcctttcactttgccaagtggtaactctgcggtttgtgacaggctgtcaaattgatggccactggcaatcaccacacactgatgtgacatgagtgtgtcgccactgcgcagttgccacagttgagtctctggctgccaagtcaatgcatcaatcggagtctgataatgcgcagtgagcttgccctgctgctctaaaagatggattaagccttgagtcagctccgcagggctgagccagcctccgagcggataatgcacactggctttatccactggcacgccgacttgttgattggtttgctctgcggataaaccatgcactaattgtgttgggaaattcccctcaagcatgctcttgagtttgtccgtggctttttcatcccacattaattgagtcacgccgcaccaatcgtggtcaaagtttatctgctccgccgcttgttcaatccattggcgggcaaacagaaaggcaggcgcaaacactcgtgaaaccgcgttgtgatcgccactgagtagcggatagaccgcgccttgtcggttaccggatgcaccttgcgccggtttctcatcggcgcagtaaagcgtgacggcaacaccgcgtctggctaaggttgtcgctagcgtggcactggcgataccaccgccgatgatggccacctcttgtaggccgtgagtggcctcaaaacgaaattcgggtgcgatattggtgtaaggtactttttcactcaggctgccggcgatcatttcacgcttagtgccaaagcctttgacctttttcatcgcaaaacccgcgtcaatcaagccgcggcggacaaagccagccgaagtaaaggtggcgcaggtacagccatgtttcgccagttttgccatacctgcaaacaggttttgattccacatctcggggtttttgctgggagcaaaaccatcgaggaaccatgcatccactaagccttgctcttgtgttgcgactttcggcaggcagtctttgatatccccaaaccagagatcgagcgtgacgagtccatcattcaacacaatccgctgacactctggaatggctaacgggtagtgcttgtgcagtttttgcgcgaattgcgccagttccggccacgcttgatgcgcttgaattaaatcgcttttactgagcgggtatttttcaaaactgatgaaatgcagctctttgagtttggcatcgggattggcttcacgaaacgcgacaaacgcttgccacaccgccagaaaattcaggccagtaccgaagccagtttctgcaatcacaaatcgtctttggtcatcgttgtgccatctttgtgggagatgattctgctcaaggaacacatagcgcgtctcagccagaccattgacgttagagaaataaacatcgtcaaattgatcagagacgggggttcctgcgtcgttccagccaagctgggcgtgtgaaatggatgacataatgaacaaattctatgaaatcaggctgaatatggctcgagattgtacgaatttatgggaaagctgaccacttctgttatccttcttcgatatcatctagccaaatttacataataggaatgttacatgaaacgagtcgtcatcaccggtatgggtattatttcgagtatcggtaacaacgtcgaagaagttttggcctcactaaaagctggcaagtcaggcatcaccgcctctgaacagtttaaagagcatggtttgcgttcacaggtttggggcgatttaaaaatcaatccagaagaacatatcgatcgtaagcaaatgcgctttatgggtgatgcggctgcgtatgcatacctatctcttgaacaagcgattgctgatgcgggtttaacccctgagcaagtgtcgaacgaccgtacgggtatcgttgctggctctggtggcgcatcttctgaaaaccaagttatcgcagtcgatactcagcgtgaaaaaggcgtaaaacgcgtgggtccttacatggtgcctcgtaccatgtcttctaccgtttctgcgtgtttggctacgccattcaaaattcgcggtgtgaactactcaatcagctctgcttgcgcgacttcggcgcactgtattggtaacgcggttgagcttatccaactgggtaagcaagacatcgtgtttgccggtggtggtgaagagctctactggtcacaaaccatgatgtttgatgcgatgggcgcactatccaccaaatacaacgaaacaccagaaaaagcgtcgcgcacttacgatgccgatcgtgatggtttcgtgatctctggcggcggcggcatggtggtggttgaagagttggaacacgctctggcgcgcggcgcaaaaatttacggtgaaatcgtcggttacggcgcgacttccgatggctacgacatggttgctccatcgggtgaaggcgctatccgttgtatgaaaatggcgatgcaaggcgtggataagattgattacatcaacacccacggcacatcaaccccagtcggtgatgtgaaagaactgggtgcaatccaagaagtgtttggcggcaatagcccagcgatttctgcaaccaaagcgatgaccggtcacgcattgggcgctgcgggtgtgcatgaagccatctattcaacactgatgctgcaccacggctttatcgctccaagtattaacattgatactttggatgaagcggcgcaaggtctggatattgtgacggaactgcgtgagcaagagctgacgactgtgatgtctaacagctttggttttggtggtacaaacgcaactttggttatcaaaaaataccaaggttaagcgcaccagatccaacacagtttccagaacagattagtttcgctaatcgaacagacgcagactctgtcccatggagagcgggataggatccttttgttctggatgtttgcccggcggcctaggtcgtcgggtatttttattctcgacagcctccgtgcttttctgcacaatgcctgcaactttgattgccgcaaattcccactatgaaaattctgattgatgagaacatgccttacgctcaagcgctgtttagtcagcttggcgaagtgatcttaaaacccggccgtaccttaaccgccgatgatctgattgatgtcgatgccttaatgattcgctcagtcaccaaagtcaatgacgctctccttgctaaagcgaatcgcttgaagttcgtgggtaccgcgaccgcgggtatggaccatgttgaccaagctctgttaagagagcgtggcatcttcttcacggcggctcctggctgtaacaaagtcggtgttgcggaatacgtgtttagcgtgctcatggtgcttgcgcagcagcaagggttctcggttttcgataaaacggtaggcatcatcggtgctggccaagtgggtagctatcttgcgaagtgtctttctggcattggcatgaaagtgctgctcaatgatccgcctaagcaagcgcaaggtgatgagcgagaatttaccgagctggaaaccttacttaaacaagcggatgtgatcactctgcatacgccgattacccgcggcggtgagtggccaacccatcatctgattgatgcggcaattcttgagcaactgcgcagtgaccagattttaattaatgcggcgcgtggccctgtagtggataacgcggcgctgaaagcgcgtttacaacaaggcgatggttttaccgctgtattagacgtgtttgagtttgaaccgcaagtggatatggaattgctaccgctgctcgcatttgccactccgcatattgcaggttatggccttgaaggtaaggcgcgtggtaccaccatgattttcaatagctactgcgagtttcttggcagtgcacactgtgcaaacccagcaagcttgttacccaaagcgcctgtgcccaaagtttatctagagcgagcatgggacgaggaaacactgcgtacgctaactcaaattatttatgatgtgcgtaaagatgacgcacagtttcgccgcgagattcaccaacccggagcgtttgacttgatgcgcaaacactattgggatagacgtgaatacagcgcggtgactctagctggaggcgctgattgccatttggctcctttggctaaactcggttttcaagtagaggtatgtgatgagccaacaatttaatgttgccatttttggcgcaaccggcgctgtaggcgaaaccatgttggaagtactgcaggagcgtgagtttcctgtggatgaacttttcctgctggccagtgagcgcagtgagggaaaaacctatcgcttcaacggtaaaaccgtgcgtgtgcaaaatgtcgaagaatttgactggtcgcaagtgcatattgcgctgttttctgccggtggtgagctttctgccaagtgggctccgattgccgcagaagcgggtgttgtggtgatcgacaacacttcacacttccgttacgactacgacattcctcttgtggtacctgaagtgaacccagaggcgattgccgaatttcgtaaccgcaatattattgctaacccaaactgctcaaccattcagatgcttgtcgcgctaaagccgatttacgatgcggtggggattgaacgcattaacgtgacgacttaccaatcggtctcaggtgctgggaaagctgggattgatgagttagcaggacaaaccgctaaactgctcaatggctatccagcggaaacgaatacttttagccagcagatcgcgtttaactgtattccacaaatcgatcagtttatggacaacggttataccaaagaagagatgaagatggtgtgggaaacccagaaaatcttcaatgatccttcgatcatggtcaacccaacgtgcgtacgtgtaccggtattctacggtcatgcggaagccgtacacgtggaaactcgcgcgccaattgatgctgagcaagtgatggatatgctagagcaaaccgatggtattgaactgttccgcggtgcggatttcccaactcaagtgcgtgatgccggcggtaaagaccatgtgttggttgggcgtgtacgaaatgacattagccaccatagtggaatcaacttgtgggtagtggcggataacgtgcgtaaaggtgctgccaccaatgcggtgcaaattgcagagctgctcgtacgcgattacttctaagcttttcatcaagttataaaaaacccaccattcggtgggtttttactatctggttcggtttacagagcgtaaagcctatggttatttcttcggcttgtgagcgttaggattgtctttgcagctaccatcactgccacatttgccgtacaaatagaggctgtggttagtcagttgcacattgtatttcgccgcgatctctttttgacgttgttcaatcacatcgtcagaaaactcgatgacttcgccacaatctaaacagactaggtggtcatggtgatgctgagttgaaagctcaaatactgacttgccgccttcaaaatggtgacgagtcacgataccagcatcatcaaattggttgagaacacggtacactgtggcaagaccaatctcttcgccgagatcaatcaactttttgtacagctcttcagcactaatatgttggcactctggctgttgtaaaacttctaaaatcttaagccgtgggagggtaactttaagaccagcatcctttagcgcttggttattgtctgacatatactttcctgttgatgttctgcagtgatacatccgttctacatgaaatggcaatcgtattggctgcgttgtcaaacccacctcaaccgttgctgtagtggggatcactcacttgccgtctacctgcatctcaattcgtttgggtataacagaagtcaatgttgctttgcattataggtgagtcaccgcgaacaataaaccacgaacttcaagaggttaatggtaaacctgcaaagtcgaggcaaatcactgaacaaagtgctcttaccagttacaataatttaacaacgatagcatcattattaggcagcaaccatgatgcattgattactgctgccttacacgaagtctagggcactcagggtatgaataaaacactctctaagctttatcaaccgaatattgtgaagtgggcactaaactcttggcctccattttggggcgctgggatccatatcgaatcgatcagtgcggattttcgcgaagttcgcatccgcttgaaattacgctggtggaataaaaacgccaaccggactcaatacggcggcagcattttctcactgacggatcccgtttatgccttgatgctgatgggcatattgggggagcgttattacgtatgggacaaagaagcgagcattaacttcattaaaccgggtgatacggatctcttcgccgaatttcgtatcacccaagagatgttggattggatcttggcgtccacagcggaaggcgataaatgcttccctgaatttattgtgcatgtcaaaaacgctcgtggcgaagtggtttcggaggtgcagcgcaagctttacgtgcgtaaaaaaccgcaatatcgcgaaagtgtcagcgagtgtattgagtaaccgtcatcggttttggcgtcggcacaaagcaatccaagcttcggcggtttttgaaacataacgttcgcgatgccaaaccacgcccaaacgccaatctatagccggtgtgatggggtagattaatacgccatccccttgaatcctttgacaaagcggcgctggaagaaagcacacgccaaccccgcttttgactaatgccaccaaaaaatcccactggctactgcgcgcggcgacttgtggcgtatagcccgctgcttggcagcaggtatgaatgtggtcacttagagtaaattcatgggtaaacagatagaaaggctcttggctgatctgcgcccaagtgagtgtggtgagtgatcgccagagaggaatatcggggaccacggcaaaaatagggtaatgatcgagggcaaccgtattgagatcgggatgctgattaggggaaagcatggtcacggccacatcaatatcaccgtctaagatcgcttgttctatcttacgtccgccatactccaccaccgttaattcgacgttagggtacgtttgacgatattgacgaaataaccgtgcgtaaacatgccccaccatgggcgggatgcctaaacgcaaatggccgcgatgcagttggtttaaatccgtgagttccgcgtccagttgctgcatttgagttaagatctgctgcgctctttgatagacaatctctccggcttcagtcagccagaagcgtcgtccttcacgatgtagaaggggttgttctaactcctgctccaaattacggatcatcttactgatggttggctgagtcacaaacaggcgctcagaggctttggtaaaactctgctggttaaccagttcaacgaagtagcgtagggcgcggatatccatcaaaagtctctttgtatgcctaaatggcatgaattaaataaatttaagtcattttatgctggtaatcgcccggaatacaatgtgacccagttcccattttatctaggcaaccttaatgcaaaacgttacgcgtacttttcagttcaagcatagcctactgattgtcgttcaagtggcggcactttcactgatttggtttttctccgattggttggtcaatcagtttcaactgccgttacccgccaatttaacgggaatgctgattttgttgttactggttatgctcaaagtagtgaatgttgagtggtttcggcgcggggcgagctggttgctggctgaaatgttgctgttttttgttccggctgtcgtggcggtagtgaattaccaagacttaatgcgccaagaggggattaaaattgctgtggttttagtggccagcaccatcttggtgatcgcatcgacggcttgggtcgtcgataaaatgcatcgagttgagctggttttagcgagacgtaaacatcgccagatagcgctggcgcgcagtgtggagaagtagaacatatgtcgacttcattactcagccttttctgttttctgctcacgttactgttttactatgcgagtaaatttctttatcgacgtaaacgcagtttgttgctgatgccgctgttactcgcgccattgctgctcgtcatcgtggtgatgatgtttcatattccttaccaagcttacatggccgatgcccattggctactgtggttactgggcccagcaaccgtcgcttttgccgttccggtttacgataaccgggcgttattgcgtcagcactggttatccttatccgttggtgtcgtggtatcggtgctggtggctatttcaagtacggtgttgttggcgcgttggctcaaccttcctgacttgctgcaacgcagccttgctatgcgttctattaccactccttttgcggtagaagcgacgaaatcgattggtggacaaagtgatctaaccgcgctgtttgtggtactgacaggggtcattggcatggctgttggtgagataatcctcaccgtgctttctattcgctctcgcttagggaaaggagcaagtttaggggcttcagctcatggtgccggcacggctaaagcctatcaaatcggtaattcagagggtgtggtgtccagcgtagtgatgatgttggcgggcatggtaactgtggtgatcgctccttggattgggcgctggttttggtgataggcagagattgaaactcccctaataaaaaatcccctgctgggcaggggattttttattttgactctgcaaattagtcttcaagttcagcgagacacatctcttcataaacttggttaacccatttggtcacgcgttgctcagttagctctggctggcgatcttcatcgatacacagaccgacgaagtgattttcatccactagggctttagaagcttcaaattcgtaaccttccgttggccagtggccgacaatggttgcgcctttcgcttgaatgatgtcacgtacggtgcccatcgcatcgcagaagtactctgcgtaatcttcttggtcaccacaaccaaaaatggcaacaagcttagttgaaaaatcaatggcttctagctcagggaaaaagtcgtcccagtcgcactgtgcttcaccgtagtaccaagtcgggatacccagcaacagcaggtcgaagttattgatgtcttctttgctgcttttggcaatatcttgtacgtgaaccagttttttaccgagttgtttttgaatcatctttgcaatagcttcggtgttgccggtgtcgctgccaaagaagatacctacacttgccatagaatcattacctttagaatgttaaagagtcgcgaagccttgcggagcttaacctagtccgctgccttcccaagtcaattgaattatgcctttggcgacaaagcctgcgcaccctaaaaagagaaccaaccacacaatacgacgcccgaaagggggaacattaccttgtttcaacacatctttaatcgccatgccaatcaagaagaagattgaggcaaacagcagatcgagtcctacagactccaacatgttcatgtagtcgtaaagcatgatattcctttatgccaaattgcttgcgcgcactataccactgttatctgacaaagttaatgcgcgtagtgtttctcaattcacacttgattgccttaaacgggcacatcaataaatttacggattgcacgtataacttcagcgggtttttccgcgtgcagccagtgtcccgtgtttgcgatcacatgagctttggcttggctaaactgggcttgcaccatgggctgatgttgtgtggtcagataatccgaatctgcccctttaataaataaggttggaatccggcatttggcgatgatatcccagcctaaaatctctgcataatgtgctttgagtgccgcaacattgaagcgccatgtcatcacgttctgttccgacattaaagatttgccgagaaattgtctaacgccttcttgctcaatatgttgcgctaaaattgccatcacttcactgcgtgacgtgggcttttgcactaacaccgcttcgagtccagcaaacacattgtcgtgacgccgttggctatacgcgacaggtgacatgtccagcaccactaattgacggactttttctgcggcaatatcggctaatttcatggccacttttccgcccatcgagtgaccgatcaccactaccgaagtgaggttgaggtgttcaagcaactggtttacgtcttgtgccatcaacgcgtaattgtgctcatcactgtggaaggatagcccgtggttacgcagatccaagctcagtacttggtgatcgtttttcagatcgcgcgcaagcaagccaagattatccaagctaccaaataagccatggatcaaaacaacggtctcaccgctgccttcaagtttgtagttaagaagtgctgacattttatcttattagtgattggtttaacgtagagtctcagtcaagatctcgctataatccccgaaagtttaaacatagagattgtgaaaagcgaatgaaaacaattgaggttgatgaggatctataccgttacattgcgagtcagactttgcatattggtgaaagtgcctccgatattttgcgtcgtcttctcaatgtagatggtgaattagccactgctgcgcctgctgctgagccgaaagggatagtcgtaagcaaagatgccgctttcgataccaaaattgatggtgttaaagcgatgcgttcactgctgatttccgatgaatttgccgggctaaaaaatgcgatcgatcgcttcatgctgattctgtctactcttcatcgcatcgactctgcgagcttttctgaagcgactatgttcaaaggtcgcaagcgcgtttactttgctgataacgaacagacgttgcttgccagcgggcaaacaaccaaacctaaggcgatcccaaatacgccgttttgggtgatcaccaacaacaacactagccgcaagcaacagatggttgaacaggtgatggtgcgcatgggcttcccaagcgacattattgagaaagttacccattccatttgaattttgctgattacagcccaaaattctgattcaagcctcataatgcgtagtgctacaccgctattatgaggttttattttatgtgaaatttaaagaaaggatgtcactatggctatgcaccctcgtgctggacaaaaggcgcgacaagaggatctccataatatccctgcgctagttgcaaattactacctactccagcctgaagctggcaatacggcgcataaagttgaatttggtacgtcgggacaccgaggtacggccgataaaactacctttaatgagcatcatattcttgcgattgcgcaagcggtagcggatgtgcgccatgaacatggtgtgactggcccaatctttattggcaaagatactcatgcgctgtctgaacctgcattcagtagtgttctggaagtgttgattgccaatggcattgaagtgattgtgcaagaaaacaacggttacacaccaacgccgggcatttcacacgctattttaacgtacaacctgaagcatgcagataaagcggacggcattgtgattaccccttcgcacaacccgccacaagatggtggcatcaaatacaacccaccacacggtggcccggcggaaggggagttaacccaagcgattgaagatcgtgccaatgcttacatcagtcagcagcttgctggtgtaaaacgcatgccgattgcgttggctaaacaatccgagttgctcaagcaagtcgatttggttaagccttacgttgatgatctggtcaatgtggttgatatggcggcaatccaaaaggccaagctcaaaattggggtcgatcctctgggtggcagtggcattgattactggcgtcaaattggcaacgcttaccaactcgatttaacgctggtcagcgaagccattgatccaagcttccaattcatgtcattagataaagatggcgtgatccgtatggattgctcttctccatatgccatggcgggtttgctggccctgaaagatgaatacgacttggcttttggtaacgatcctgactacgaccgtcacggcattgtgacccctaaaggcttgatgaatccgaatcacttcctcgcggtgtgcattgattatctgtaccgtcatcgtcaaggttgggcgggccatgttgccgtcggtaaaacgctggtttccagtgcgatgattgataaagtggttgccgatcttggccgcgaactgtgtgaagttccagtaggcttcaaatggtttgttgatggactctactctggtcgctttggttttggcggtgaagagagtgcgggggcttctttcctgcgtcaagatggcacgccttggtctaccgacaaagatgggatcattttgtgcttactggcagcggaaattaccgctgtgaccggcaaaaatccgcaacagtattatgatgaattggcagctaaacacggtgatttttattacagccgtattcaagccgtggcgaatggtccacagaagaatgtgctaaagaaactgtctcctgaaatggtgtcggctcaaacgctagcgggagatgcaattacggctcgcttgactcatgctccgggtaatggcgcagccattggcggcctcaaagtgactacggattatggttggtttgcggctcgtccatctggcacagaagatatctataagatttattgtgagagcttcaaaggggctgagcacttaaaacaaattgaatctgaagcgcagcagatcgtaaaccaagtgtttaaagacgcgggtttataatgtgatgaaatgaatcaggggcgatgagatcgccccttttttatgtctcttaacgctgtggccactggtttggcacaataaaccagaatttcccagattcagattggcaatgcacaaacccatctgcgtgttctgtataaggttcagagtctgctttccgtcccgtcaaccaatctgacttttcaagctgatataaaggttcatcgattaagtgctgctcacgctggaaacaccaatagccttgaatctggctagtattgagcgggtagccaagacaatcggtcgggattggctcatcagaaaatggattggtataaagacgaccctgcattaataaatgttgtgatgcaccagcccagagtggatgttgttcaataaaaagcggatgttgtgatagcggcagttggtggttgagcatatggtcaagtttgatatccaaacgatcttcggcattggggccgtaccaacatccttggtggagcagataaaatttgactgccacttcccaatgttcatagtgttcagttttacggtttttagctaaaaaatccaatgaaccgacggtttttccttcattaatgagctgaatttcttctgaaaccgcattgtaaaatggcgtttcggtgaataattgagcgcaaagatgttgatagagaaagcctaatcgtggattgccctgatagtctggccactgctctcgtgttgttttgctaaatggcgctttgctgaccaaaggcgctttggcttgaaatagggcaggggtgcgaatcacccaatccattaagtgttttaactccatctgatcaccaccactttttgacatatttcgacattctagcctgaaattgttataaccacgccacctctgttgctcaatggattacaagatgaacaatttacagctagaagcgttgctaaatgagacattgtccccacagttaattaaagattattgtcctaatggtttacaagtcgaaggtaaagtggaagtcaaacgaattgtcaccggtgtgaccgctagcatggctttaattgaagctgcgattgagttgaaagctgatgctcttctggttcaccacggctatttttggaaaaatgaacccgaggccattcgaggtatgaaaggtcgccggatacgtacgcttatccaaaatgatcttaatctgtatgcctaccatctacctttggatattcatccacagttgggcaacaatgctcagcttgcgcagcgactcgggatttgcgttgatggtgggttggaagggcatcctcaatcagttgcgatgtttgggcactttttacaaccgttaaccggagaagaattagctcatcggattggccaagtcctgaatcgtactcctttgcatattgctcccgatcaagccgataagctgattgaaactgtcggttggtgtacgggtggtgggcaagactatattgaactcgcggctagccgaggtttagatgcctttatttctggagaaatctcggagcgtacaacctattcggcacgtgaacagtcgatccattacttttccgcaggtcaccatgctaccgagcgctacggaattaaagcactaggggaatggctcgcggaaaatcacggctttgatgtgaccttcattgatattgataatccagtttagaacaataaaaaagagcgagaaaatctcgctcttttgcttttgaatcaatgattaactgcgttcatgcaagggtgtgaaatcgcgcagtttttgacctgtgtacaactgacgtggacgaccgatacggttgtccggatcgctgtgcatttcattccagtgagcaatccaaccgatagtacgagacatcgcaaagatcaccgtgaacatagacacaggaataccaatggctttgagaatgatgcctgagtagaaatcgacgttaggatagagtttcttctcaataaagtactcatcagacagcgcaatacgctcaagttccatcgcgacgtcgagcagtggatcttgaatgcttagctctttcagcacttcatgacacgcttcacgcattacagtggcacgtggatcgtagtttttgtacactcggtgaccaaagcccattagacggaatgggtcatctttgtcttttgcacgtcttacgtattcaggaatcttatcaacagagccgatctcttcaagcatacgtagacaagcttcgtttgcgccaccatgtgcagggccccaaagagaagcgatacctgctgcgatacacgcaaatgggttagcacccgatgaacctgccagacgtacagtcgatgtcgatgcgttttgttcatgatccgcatgtagagtgaaaatcttgtccatggcacgagccacgataggattcacttcatactcctcacaaggtgtggcaaacatcatgtgcaggaagttttctgcatagctcaaatcgttacgtgggtagataaacggttgaccaactgagtatttgtaacacatcgcagccaaggtcggcattttggaaagcagacgataagccgcaatttctcggtgggtgtcgttattgatatcgagtgaatcatgatagaaagcagctaacgcacccaccacaccacacatcacagccatcgggtgagcatcacggcggaaaccgtggaaaaagctcgcgatctgttcatgaaccatagtgtgacgagtaacgattttcttgaactcttcatattgcttacgattaggggcttcaccgtaaagaaggatgtaacacacttccaagtaatcagcgttattggctaactgatcgatagggtagccgcggtgcaacagaatgcccttagcgccatcgatataagtaatttgagattcacaggatgcagtggcaagaaaacccgggtcaaaagtaaagtaaccgtttgagcctaaagtacgaacgtcaatcacttgtggaccaagcgatccatccataattggcaattcgattggcgctttaccttcgatgtgaagggtcgctttcttatccgccataaccatctcctttgtttattatttaatccgtccaggatgttttgtgtgtgattcttgtacgtccgatcttaatcaaagtcaattattctcctctgatgtgtgcactcactttgattttttatacgtataaagttaaaaatctgttctgtgtagcaaaaattgttacagcaattgtattagaatgttgcagtccgtatagtgacacagaaaattctgtgagagaccttataaattcaaggctagaaagaaatttaacttatagattttagacttgggtgtaacatttaaactacaattaagtcgccgatttggcggttgaaatgttgaataaatgttaaattatgcgcattttcgaccagaattcatccataactataaatgctcaatggagctgagtgagcaagcccgtgaaagaaagaaagtcaagacctgttaatttagatttgcagaccattagctttccgatctcagcaatcgcatccatcctccaccgtgtgtcgggggtgattacgtttgttgcggttgggattttgctttggttgttatccctctcactctcctcacctgtcggatttatggaagcgagcaacattgttgacagctttttcgtgaaattcgtgttgtggggaattctaactgctctggcctaccacattgctggtgggattcgtcatttattgatggatcttggtcactttgaagagctggaatccggtgccgcgagcgccaaagtagcttttgccgctacggttgtattgtctctactggcgggggttctggtatggtaaagcatgtctcttcctttggtcgtaatggtgttcacgattacttattgatccgcgcttcagcgatcatcttagttttgtacactatttatatcgtgagtttttgcgcgttcacggacatctcttatgtcgcgtggactcaattctttggtagcacgttcaccaaagtcttcacaatgttggcattagtttcagtattgattcatggctggattggcctatggcaagtactgacggattacattaagtgctccaaattgcgtgcaggactgcaacttgtggtcatcgccgttctacttggatacttcttctctggcctatttgtattgtggggtgcctaagtgactattccagttcgttcttttgacgccgtagtaatcggcgcaggtggtgcaggtatgcgtgctgcactacaaatttctgagcaaggcctaacttgcgcactgctttcaaaagtgtttccaactcgttctcatacggtatccgctcaaggcggcattaccgtggctttgggtaactcacataaagatgattggcagtggcatatgtatgacacggtaaaaggttccgactatatcggcgaccaaaatgccatcgaatacatgtgtaaaaacggcccggaatccgtgattgaacttgagcgcatggggctacctttttctcgttttgagaacggcacgatttatcagcgtccttttggcggtcagtcaaaagagttcggtggtgaacaagctgctcgtacggcagcagcagcagaccgtactggtcatgctctactgcacacgctttaccaacaaaacgttaaacataaaaccaccattttctcggaatggtatgcactggatctggtgaaaaaccaagatggtgctgtgctcggttgtactgcaatctgcatggaaacaggcgaaatttgctacttcaaagccaaagcaacagtgcttgcgacaggcggtgcaggtcgtatttacgcttcaaccaccaatgcacacattaacacgggcgatggtgtcggtatggctttgcgtgctggcgtaccaatgcaagatatggaaatgtggcaattccacccaacgggtatcgcgggtgctggcgttctggttacagaaggctgtcgtggcgaaggtggctatctgctgaataaagatggtgagcgtttcatggaacgttacgcgcctaacgctaaagatctagcaggtcgcgacgtggttgcacgttcaatgatgatcgaaatccgtgaaggtcgtggttgtgatggcccatggggtccacacatcaaactgaaactggatcatttaggtcgtgatgtattggaatctcgcctaccgggtatctgtgaactatcacgtacctttgctcacgtggacccagtgaaagaacctattcctgttatcccaacctgtcactacatgatgggtggcgtaccaacacaagtgtctggtcaagcgatcaaacaagacagccatggtaaagatgttgaagtccaaggcttgtttgcttgtggtgaaatcgcttctgtatcggtacatggtgccaaccgtttaggcggcaactcactgcttgatctggtggtatttggccgcgcaacgggtctacatcttggtgaaactctgcgtgctcaagctgaggctcgccctgcgactgcatcggatatcgaagcttctctggctcgtactatgcgttgggaaaacagcaaaggtggcgaagatcctgtcgtgattcgtaaagatctgcagcgctgcatgcaaaacaacttctcggtattccgtgaaggtaaggcgatggctgaggggctggaagagctcaaagtcatccgcgaacgtttgaaaaatgcccatctggcggacaaatcaaccgaatttaacactcaacgtattgagtgtttagagttggacaacctgatggaaacggcattttcgactgcagtagcggcaaactaccgtactgaaagccgtggtgcacatgcgcgttttgactatccagagcgtgatgatgagaactggttgtgccactcaatctacaatccggaaacggaacagatgagtaagcgtgaggtcaatatgacaccggtttaccgtgacccgttcccgcctaaagtgcgtacatattaagggaggtactcaatatgaaactcaacttctccttatatcgctataatccggatgtcgataacaaaccctacatgaaagactacattcttgaggtagaggaagggtctgacatgatggtgttggatgctttgattctgcttaaagagcaagatccaagtattgctttccgccgctcatgccgtgaaggggtttgtggctcggacggtctgaatatgaatggtaagaatggcttagcatgtatcacacctttgtctgcgttaaaaggtgacaaaattgtgattcgtccgctgccaggattacctgtggttcgtgacttgattgtcgacatgactcagttttacgataactatgcgaaagttaagcctttcttgattgcagatgatgcattacccccttcaagagagaacttgcaatccccagaagaacgggcgcatttggatggtctgtacgagtgtattatgtgcgcttgctgtaccacttcctgcccttcattctggtggaatccggataaatttatcggacctgcaggtttgttggctgcttatcgttggttgattgatagccgtgataccgcgacagatgaacgcttatcgaatcttgatgatgcgtttagcgtttttcgttgccacggcatcatgaactgtgtcagtgtttgtccgaaaggattaaacccaacgaaagccattggacatattaagtccatgttgatcaatcgttcagtttaaattgaaaattgcaggccttcgggcctgccttttatagctcggcgataagaccgcagcaaacgtgaaaactactggttaagggaaaaaaatgcacaacggcgtgatgaaggcatggctcgagtcttcacacttggctggcgccaatgcaacttacgtagaagatctctacgaactgtatctaagtgatcccgatctggtaagtgaggagtggaaacgtgtttttgatgggttgcctgcgcacccaacgaatgtggttgaacaaccgcactcacgcgtccgtgactacttccgacgactcgctcaagagactaagcattacaatgtccaagttagtgatcctgaagtcgatgcaaaacaagtaaaagtactgcagctaattaacgcataccgtttccgcggtcatgaagctgccaagcttgaccctctcggtttatggaaccgccctgaagtggcggaactgaatccctcattccataatttgacccaagaagatatggaagagaccttcaacgtgggctcctttgcgattggcaaagacacgatgaagctgaaagatatctatcaatccctacaaaaaatctactgtggctctgtcggtgcagaatacatgcacatcaccgacactgagcagaagcgttggattcaacagcgtctcgaaccagttgtgggtacccctgtattcagtaaagaagaaaagcgtactttccttgaagagctgactgcagctgaaggtttagagcgctatcttggtgcgaaattccctggtgctaaacgtttctctctcgaagggggggatgccttagttccgatgaccaaagagatgatccgtcacgcgggtgccagtggcatgcgtgaagtggtgattgggatggcgcaccgcggtcgcttgaacatgctggtcaacgttctgggtaaaaaaccgcaagatctgtttgatgagtttgccggtaaacatggcgaaggctggggcacaggtgatgtgaaatatcaccaaggtttctccgctgactttgcgacaccgggcggtgatgttcacttagcactggctttcaacccatcgcatcttgagattgtgaaccctgttgtgatgggttcagtgcgcgcgcgtcaagaccgcctaggtgatgaagatggcagtaaagtgctacctatcactatccatggtgactctgcgattgcaggacaaggtgtggtggctgaaaccttcaacatgtctcaagcgcgtggtttctgcgtcggtggtacagtacgtatcgtggtcaataaccaagtgggcttcacgacatcaaacccacgcgatactcgctcaaccatgtactgtaccgatattgccaagatggtacaggcaccgattttccacgtgaattcagacgatcctgaagctgtagcctttgtcactcgtctagcgcttgattaccgtaatgaattcaaacgcgatgtggtgattgatctggtgtgttatcgccgtcatggtcataacgaagcggatgagccaaacgcaactcagccattgatgtaccaaaaaatcaagaagcatccaacacctcgcaagctgtatgcagatgtgttaactgagcgtggtgagtgcgatctcgaaaccgcgactcaactggtgaatgaatatcgcgatgccctagatcacggtgaagtggtggtcaaagaatggcgtccaatggcgatgcactctgtggactggtcaccgtatttaggtcacgactggcatatcccttggaatagcgaatatgcgatggagcgattgcaagatcttggtcgtcgtgtttgccaatatccggaaagccatgtgttgcatagccgtgtagaaaaaatctatcaagatcgtctctctatgatctctggcgagaagatgctggattggggtatggctgaaacgcttgcgtatgccacattgcttgatgacggtaagcgcatccgtatctcgggtcaggactctggtcgtggaaccttcttccaccgtcacgccgttctgcataaccaaaacgatgcgagtacttatattccactctcacagatccatgctggccaaggcccgtttgaagtctttgactcagtattgtcagaagaggcggtattggcattcgaatacggctatgcgacagcggagcctagcggtttgacgttgtgggaagcacagtttggtgattttgctaacggtgcgcaggtggttattgaccagtttatctcctctggtgaacagaagtggggtcgtctatgtggcctgactatgttgctgccacacggttatgaaggccaaggccctgagcactcctctgcacgtttagagcgttacttgcagctgtgtgctgagcaaaacatgcaggtggttgttccgtctacccctgctcaggtttaccacatgattcgtcgtcaagtggttcgcccaatgcgccgccctctggtggtgatgtctcctaaatcgctgctgcgtcatccactgtgtgtctccagtatggaagatcttgcccacggtactttccagccggcgattggtgaaattgatgcgctgaatccgtcgcaagtaaaacgcgttgtgttctgttctggtaaggtttattacgatctccttgaacagcgccgagccaatgaacagcaagacgtggcgattgttcgtatcgaacagttgtacccattccctctggaagaagtacaagcggccattgcaaattacaccaatgtggtggattacgtctggtgtcaggaagaaccgcaaaaccaaggtgcttggtacagtagccaacataacttccgcgctgcgattccagcgggtgctgatctgaaatacgcaggtcgtcccgcttcggcatctcctgcggtcggctatatgtcggtgcacatgaaacaacaaaaagcgttgattgaagacgctctgaccctagcgtaagaacgagaagtataaggaagataccattatgaccattgaaattctggttccagatttgcctgaatcagttgcggatgccacggttgcgacgtggcataaaaagccgggtgacatggttgctcgcgatgaagtgatcgttgaaattgaaactgacaaagtggtgctggaagttccagcacccgatgccggtgttctggaagctattttggaacaagaaggtgcgacagtgctttctaaacaactgctggcacgtttgaagccaggcgctgtagcgggtgaaccaacccaagatactccagatgctactgagccatcaccagataaacgccataaagcatcactaactgaagaaagcaatgatgcgctaagccctgcggttcgtcgcctgcttgctgaacataacttggaagcaaaccaagttaaaggttctggtgtgggtggtcgtattacccgcgaagacatcgaagctcacttagccgcgaacaaagccaaaccagctgcgaaagctgaagcccctatcgcagcgctggctcctgtcgtcggccgcagtgaaaagcgcgtgccaatgacacgtctgcgtaagcgtatcgctgagcgtctgttggaagcgaaaaataacacggctatgctgacgacgtttaatgaagtgaacatgaaacctatcatggacatgcgtaagcaataccaagatgtgttcgaaaaacgtcatggcattcgtctgggctttatgtcgttctacgtgaaagctgtcactgaagcgctgaagcgttacccagaagtgaacgcgtctatcgatggtgatgatctggtttaccacaactactttgatgtgagcattgccgtatcaaccccacgtggtctggttactccagtactgaaaaactgcgataccttgagtttggcgcaaattgaaaaaggcatcaaagagctagcagaaaaaggtcgtgacggtaaattgaccgtagacgaactgactggcggtaactttaccatcaccaacggtggtgtgtttggttcactgatgtcaacgcctatcattaacccgccacaagcggcgattctgggtatgcataagatccaagaccgcgccatggtggtggatggcaagattgaaatcctgccaatgatgtatctagcgctgtcttatgaccaccgttcaatcgatggtcgtgagtcggttggtttcctagtgaccgttaaagagttgctagaagatccagcccgtctgctgctcgatgtttaaactgtcttttgctcagatttctgagtaatggagaaaagggtcggacatgctcaacgtccgacctggctttggccaaagattggctactcgctcaagagtgaccctacaaacgtaaagttcagctcaatggactctatggaagaacaataaacaaatggaacaacacaatgaatttgcatgaatatcaagctaaacagctgtttgcagaattcggtttgcctgtaccggaaggttatgcttgtgatacgccacaagaagcgtttgaagctgcaggacgcatcagcacagccaagaaagtcgtaaaatgccaagttcacgcaggtggacgtggtaaagcaggtggcgttgaactgcatgacactaaagaaggcgtaaaagcgtttgcacaaaaatggctaggtaagaacctagtaacttatcaaacggatgcaaatggccaaccggtttcaaaaattttggttgaagaagcatcaaatatcgctaatgagctttatcttggtgcggtagttgaccgttctacacgtcgtatcgttttcatggcatcgactgaaggtggcgtggaaattgagaaagtggcagaagaaactccagaactgatccacaaagcggcgattgatccactggttggcccacaagcctaccaaggtcgtgaattggcgttcaagctaggcctgcaaggtgatcaaatcaaacagttcgtgaaaatcttcatgggcttgggtgaaatgtttgctcaatatgatctcgcactgctggaaatcaacccgctggtgattactgcggaaggtaacttgctgtgccttgatggcaaaatcaacatcgactccaatgctatgtaccgtcaacccaaactgcgtcaaatgcacgatgcttctcaagaagatgcgcgcgaagcacacgcagcgaaatgggagcttaactacgttgcgctggatggtaacgtaggctgtatggttaacggtgctggccttgcgatgggtacgatggacattgttaacttgcacggcggaaaacccgcaaacttccttgatgttggtggcggcgcgaccaaagagcgtgttgcagaagccttcaaaatcatcttgtctgataccaatgtaaaagccgtactggtgaacatctttggtggcattgtgcgctgcgacatgattgcagaaggcattatcggtgcagtgaaggaagttggtgtaagcgttccagtggttgtgcgtcttgaaggtacaaacgcagaacttggacgtaaagtactggcagaatcaggtctagatattattgcagctgtatctttgacagacgcagcgcaaaaagtagttgccgcggcggagggcaaataatgtcgattcttatcaataaagacactaaagtcatttgtcagggtttcaccggtggtcaaggtactttccactctgaacaggcgattgcttatggcacacaaatggttggtggtgtatcgccaggtaaaggcggtaccacgcatctaggtctaccggtatttaataccgttcgtgaagccgttgaagtgactggcgcaaccgcaactgttatctacgtaccagcaccattttgtaaagatgcgattctggaagcgatcgatgctggcatcaagcttattgtgaccatcactgaaggcattcctaccactgacatgattgatgtcaaagtgaaactggaacagactggcgttcgtatgattggccctaactgcccaggtgtgattacaccggatgagtgtaagattggcatcatgccaggacacattcacaagaaaggtaaagtgggtatcgtttctcgctctggtactttgacttatgaagcggttaaacaaaccacagacgaaggtttcggccagtctacctgtgtgggcatcggtggcgacccaattccggggtcaaacttcatcgacatcctgaagatgttccaagaagatccagcgactgaagcgattgtgatgatcggtgaaatcggcggtaccgcggaagaagaagcagctgctttcatcaaagccaacgtcacaaaacctgtcgtttcttatatcgcaggtgtaacggctcctccgggcaaacgcatgggtcatgctggtgcgatcatctctggtggtaaaggtaccgctgaagagaaatttgcagcacttgagtctgcgggcgtgaagacagtaaaaagtcttgccgatattggcaaagcgctgcgtgaagtgactggctggtaatctaccgcgattacttactcagataataagaaaccccgaacacagcttcggggtttctttttactaaatgccatttctttttactaaaagctaatctgatacagcgttaagcgacccgtttaaactgggtgagtacaaacaataccgcagcagaaaccaccaccgacggacctgcaggtgtgtcaaagtgccaagatagcgccaacccaccgatcacacttaatacacccagtccaattgcccaaaacgccatggcttctggggtgcgtgaaagacggcgagcagtagccgcggggatgattaacagcgagcccataatcaaagccccgacaaatttcatcccgacggcaatcaccaaaccgataagtagcatcaagattaaacgcatcaggtcagtgttggttccttcaacaaaggccaactcttcattcacgctagtcgagagaaggggttgccagaggagatagacaatcaaactgacagtgacgacaccgaaccagataaaggtaagatcggatgggctaatcgcgagcaaatcaccaaacagatagctcatcaaatcgatgcggacattatcaagaaagctcaccgcaatcataccgagcgatagcgcgctgtgcgccataatcccaagtagggtatcggtcgcgatgagtttttgcttttgcatcgccactaaaatggccgccatccccaaacagcagaccaatagtgccagatacagattgatgtcgagtaaaaaaccgagcgccagacccagtagtgaggcgtgagcaagggtatcaccaaaataagccattctgcgccaaaccacgaaagatccgagagggccagcaataatggcaattccgaggccagcaagaagagaaggtagaagaagttcaatcatgtttgtggtgaccatgtgaatgatgtgagcaaacactcgcttttcctttgactggtaagccagataaatcgtggtggtggtgctcgtggtggtgttgataaaaagccagcgtgtctcggcttcgatggccaaacatcgctaaataactcgggtgtttggcgatgctctccggcgagccagagcaacagacatggtgttgtaagcagatcacttcgtcggttttggccatcaccaaatgtaaatcgtgagaaaccatcaacacagcgcagccaaagcggttacgcaaggtgtggatcaggtcgtataagtcaatttgtccttgtacatcaaccccttgagcaggctcatcgagcacaagcaagtcgggtctttgtaataaagctctggcgagcaatacacgctgtgtttcaccgccggagagtttatgcatatcactactttgaagatgctcacctcccactaggcgtaaggcttccgatagctcttgggtactaaaacggccagccagttttaaaaagcggttcaccgtcagcggtaatgtgtcattgagtttgagtttttgtggaacatagccgatacgaattcccgattggcgaatgatttttcctgaactcaatgattgtaatcctaaaatgactttcactaaggttgattttcctgcaccgttggggccgataagcgttgtaatattgcctttggtgagagttaaccggatattgtcaagcacacgtctttgttcaaagtcgacgcatatgtcttgcaattcaatcagaatagccatggaatagaactcatttgcaaaatggttatgttataaagtaacattcatgcccaataaaagccactaactggagtttggcgaccatgttatcgagatattttttacttactgtcgcagcactgtttgctcaatcagccagcgcaatcgaagttctgaccagcatcaagccgatacagatgatcacttacgagttgatgctggggacggggactcccgatgtacttttaccttctggagcatcgccgcacgattatgcgctacgcccttcagatgtaaagcggattcaacaagcagatttggttatttggtttggtcaggatcttgaacccttcatgagtaaactgctggaaggccgtacgtcagcactaacattaagccaagtccctaatttagcactgcgagaatatggcgaggaggagcagcatgagcatgatgggcaccatcacgggcattatgatcctcatttctggttagggattgggcctgtaggacaagttgcaagtgcaattacggcaaaactgattgagctcgatgcggatcagcagcagcagtatcaagataatcttgttcgctttttagcgaaccttgccgagcaagacaacacgataggtgaaaagctcaaacctgtcacgaccgtaccttattacgtttttcatgatgcttatggttatttcgaacagcactttgcattaaataatctaggccacttcacggtgagtcctgagcgaaagccgggagccaagacgctgatcgccattaaaaagacgctaaatgatcaactcgccaagtgtgtattttcagaaccgcaatttgagccagcgattatcgaaaccgttgttagaggcacgtcggcgaaaattggtgtgctcgatccactcggcatctctattgaactccaagcgggtagctatttcgccttcctaaatagtttggcggagagttactacgcgtgtttgtcccaatcttaagtcgaccaacttctctaacattgttctaaatgcggcttaagccgcatttttttgtatccaaaacctaaaaaagtggtctttctaaacctttcaaactgcatacccgctagggattcgttagaatgcatgagaatttgtgctcctctagaataccgaaaccaataaagcacgaattcttgaattgtcgctgacaggggaactcgtgtttcgcacattgttgtatggctgcttgctcaatatcctgatcccatccttggtattggcattagataaatctatgtctattttctatcctttgcccattcaagagcaggggaaagttattgttgcgcaaaatctctacctcggtagtgatggggggatttgggtacatgatgttcatggcaaagtgatgtactttgatggacaaaacgtcttgcctcgtcgtggttctgttctgccgcagttgtccagtcatattgtttatgcgaacagtgcattttgggcttttgagcaacacgagttgttcagaacctatcccgggggagaaagagagctgatgttgagcttaactccgggaacgcagattattcagatgggggcctcaaatggcatgatctggatggttgatggggaaaacttctatagttatgagatccgaagtggccgcgtcgaatccctctcgttacatgaactttatcagctcaatagtgccagcaaggtcgtgattaacgatgcgcagtttttagtctcgaaatgggctttagcgactaatgttggggtgtatttatctgatgaacaaggttttgcccatgtaaaaaattctggcaagcactttatccaaaagctctatttttcccataagcggcgagagctgttagttgggtctaaacgtggcgcgttagtcattgatattgaaaataaacgtccaccactggatagaattggttcctcccatgtcctctctattgcggaaaccgagaaagagtactggatcggtacagaagatgggctctttgtttactcttttatcaccgggaaaatcgtgcaacttgagagtaacaaccaagatggctatgccttactgggcaagaaaatctacgccatggtgaatgactttcaaggtgggatgtggataggaactgacaaggggattttttattactccctatttggtcagcagtttactcggtatccggcgcaagcattatctaacgacggaagtaaaacaccgatcggtaaaatagcagctcttaactcggatggagactatctggcgataaccgcacaaggcctgtataactttaatttttcagatgagctacgtaagcatcttatctatccaggtaaagtaaatgattttgtgattgcccaagagcatctctggatcgcgacagagaaaggtctggttcgttacaatctcagtcgtcgtagtattgatacgcccaatttaccgctccctttgctacaaacggctattcagcatctgagcttagatagtgacggtaacttatgggggacaagtgattaccaaatatggtcatactcactctctgaaaaaaattatcgagattatggttctgaatggatggtgaaggctttttctccatcaaggatcactctgcttgccgcagtaaaagacggcatagtgattgggacggaacatggcgcttattccctgcttgaaaaacagatccgctttgatttttcgagtcatcgctatggtgagattttacaagttgctgaagattcttcaggccacatttggcttgttggctcttatggggtttttcagtggcgtaaagatcagcccgaagctgtcactgtcgagttaattgaagagaatatacagcctttgtgtattgctgagtctaagcaggggatgtggcttatctccaccaaagggatcagttattaccgtaatcaagagctcactaagcattttggggctccttatggactgatcagtaatgagttcttgtctgcatcgtgtgcggtgggtgaggagcaagataactcatcgttgatcataggatcgcaatttggtgtagtgaaaaccaatacagaagaattagcggtgtctaatttgcccaatattcaggtgacgtttagccaagtcagcgtaaatcatacgaccaagcttttggggtatcgtatgtccgagccactgaaaattgcttatggtgattcgatcagctttcagtttggcgctttaccctcttcacgcagccaatctttagaatacaaactcaacgatgaacagcagtggcagcgctttgattgggcgctgctcaattttgatcaacttttacctggtaagtatcgtttgaaagtccgtagcgctaatccgacacagcgataccgaactgaggccctgtttgattttgaagtcttacagccttggtatatgacctccatcgcgcttgtcggatatgtgctgagcgtgttggggttattagcactcgctttatggtggcgaacaagaatgatattggcagctaaccgcaaactcaaagcgcaagtggagctcaaaaccagtcagttacgtcatcaaagtaaaattgtgctgagcaacaaccaccaacttcgaaagcaactgcagctccaccatacaattcttggtaacgtgttagacaatattgatgcttcattgcggcacttatcttcctacgccaaagtacgagcatggagtgaatttgaagcaccgttcaacaaggtgaagcaagagttggctcaactgcattttatgcatcgcggcgatgaggatgaaagcaaatatcatgatttgcatcttttgattgagtctgcattgaagagttggcaggaagagtacagtaaagccttgattaagctaacttacagcggtgagcctcgctttgtggaagtccgacaattcaaccttgatgtgttatttaatgctgtattaacggatgcgatcaaacgtttgtataagcatcaagaattaaccatacaacttgaagtgagaaatgcgcaggcggttatcgtattttctgattttggtgccccaatccaaaacatagacaaaaccatggtgacgttatctggtagtagttatccgcttgaagagttagtcattcgcagtggtggtgtattgcatgtgctcgcgttgaaagagcgtaatgtgattgagttagcttggccattggcaaccttacccgagttagaaaccattcataaaccagaagaaggggaacaggcggctaaggttgggatcgatgaggtggagaaggagtggctaagcaaagtcgagaaactgattgagctgcattatagcgaccccaatttcaccacatccactgcagcgcaggcgctttatgtctctgaacgcagtttacagcgtcgctttaaagccgcgacaggaaaaaccttcaaagagtcgttaaatgaggttcgcttagaaaaagcgtgtcaaagcttattgagtggggcgaaaatcgcacaagttgcctttgattgcggatttaatgatccctcttatttcagtcagcgtttcaaacatcattttggattatcaccaagccaattcatcgaagatcaagaaaactaatagagcccatctctatttcatcttgttgttctcaaatcgcctagtattgcagtaagccagcaacggtattgatcaaagtgagcataggcggatttgtgtgattagaaaatgaacccaccaatgctccttcagttttaataaatagcaaaggtacccgtgagaacttagctcggtagtcgataacagtgcgctacaaatgtgatgaattttgttcagacaaacataagctaacaagcttgtcgctgaatcggctcaagaaacaaatgctattgaagtgagtgatggtaatagaggtaaaacagtaggaaaaaaatatcgtggtatagccggggggactataccacgggtgtcaacgacaccttcgcttgctgccggagtggtatgacatggtcataccacctctggaattcttgtctctaggagggatgtcctttcaacgaaatcactataatcctatagacttattttacttataaaattaacgacaactttacatagaaaaacgacagcagcttaatcatgtttttaaggtgttgattttaaatatgtaaatgtaatttgtcgttttttctatcatgttgattttatgcaggagacttttctgacttggtctttgacgtttttgacgaaaagtttttgacagaattgacgttgactattacctaagcaaacattgttttcgcgcaagaaaaccttaccctgcgtatggtaagttcgtttaatattaatagtaatatttcttattaacacttccttttcaaagttacctctatgaaattgtcacaaatgcaagcaggcgagcgtggaatcatccttgcattggatggactttctgatacggtcagaaagaaactgatggtgatgggcgttctccccaataccgaagtcgtattaattcgccgagctccaatgggtgatccgcttcaagttgaagtacgcggtgtgtcgatcgcgttgcgcgaaaatattgcggcaaatattgatgtggagagagcacaatgaagtatcaagtactcaccgtaggcaacccgaatagtggaaaaacaaccttattcaatggtctcactggggcaaaacagcaagtcggtaactgggcgggggtcactgttgagaaaaaaacgggtagttttgtgcatgcaggcgatgaattttcactcaccgatctgcccggaatttatgctttagacagcggtaatgacagtaacagtattgatgaatcgatcgcatcgcgtgcagtgttgacgcatcctgcggatgtgatcattaatgtggttgatgcgacgtgccttgagcgcagcttatatatgacgctgcaactgcgtgaattgcgccgtccaatgattgtcgtacttaacaaaatggatgcgcttaagcgcgaacgtgttcatctcgacctcaaacaactagaagcgtttttggggtgccctgtgttggcgctttctgccaacaataaagagcaagttcgccgctttaaagaaaaattgcataagctgctggtacaagggattgcgttaaagcagattgaacttcactacggtgctgaatttgagtcattgattcatgagctagaaccaatgtttgctgagcaagcggtttctgcgcgcgcgctggcgattcgagccttagaaaacgatcgtttagtgattaacggattaaaagaggcggagcgccaaaatgtagagcaacgtcaacatgagtgccaggttgatattgatcttctcgttgccaacgtacgttatacctatttacatgagctgtgcacccacgtgcgacgcaccgagggtaaactgagccataaattcaccgaaaaagccgatcgcgttatcctcaataagtgggttggcatcccgttcttttttgctgtgatgtacctgatgttcatgttttcaatcaacatcggcagtgcttttatcgatttctttgatattggcgtcggtgcattgttggttgatggcggacaccatttactggatgaccatctccccgtttggttagtgaccttaatcgctgatggtgttggtggcggtattcaaaccgttgcaacctttattcctgtcattgcttgcctgtatttattcttagcggtattagaaagctccggttacatgtctcgtgctgcatttgttctggataaagtgatgcagaaaatcggtttgcccggtaaagcgtttgtcccgctggtccttggcttcgggtgtaacgtaccttctattatggcaacgcgcacgctggatcaagagcgtgaacgtaagctggcggcctccatggctccgtttatgtcttgtggtgctcgtttaccggtttatgcgttgtttgcggcggcatttttcccgcaaagtggccaaaatgtggtgtttgccctctacttattagggattgttgctgcggtattgactggtttggtactgaaaaagaccctctatcctggtgtcagcgagagcttaatcatggatatgccggactatgaaatcccaaccttacaaaacgtggtgatcaaaacatggcagaagctgaagcgttttgtattgggagccggtaaaaccattgttgttgttgtgacgattttgagctttttaaactcagtcggtaccgatggttcatttggtaacgaaaacagtgataagtccgtgctttctaaagcagctcaatttgtcactcctgttttttcaccgatgggggttactcaggaaaactggcctgcaacggttggcatcattacaggtatttttgccaaagaagcggttgtggggaccttaaatagtctttacaccaacacacctgatgcagaagaggctgcggaatacgatttgctggcgagtttgcaagaagccttaatgacgattcctgacaaccttgcagggctcagtttcagcgatccactaggaattgaagtcggggatttgacggataccgaggctgttgcgcaagagcaagaagtagacggctcgatctttggtaatttacacacctattttgccaatgctcatgtagcttttgcttatctgatctttattttgctttataccccttgtgtagccgcgatgggcgcttatgtgcgcgaatttggtgcagcttacgcgcgctttattgcggtatggacgatggggctggcctacggttctgcggtgctctactaccaagctacccatattgctgagcacccaatgtatagcttaatttggattggtgtgattgtgggcatcggattcgctacctactgggcacttaaacagacagggcgtaagcaaaagatgatagaggtatctgtcgcgtgattttaaatgaactcaaagcggcgattgagtcaaaaaatggcgctacgagacaagagctcgcgcgacgttttgctctgagcgaagatggcatcgatgcgatgctcgcggtatggattaaaaaaggtgtcctatcgcgtcaacagtacatcaacgctgaggatgaggtggtgcgagtgcgctacgtcatgaatcaggtaggatcgcttgctgtgaatgtgactatgtaaaaccttccaacttgaaggtgccgcggtgttggcaacgtttgttcatcccaatcgcatagtgtatctatgctcgtggggatgaattctcttgctgcctacctgcaacgccaagtagtttgggtatagttgcttgtggtatcaccgactcataaaaaagccgcgtaatgcggtttttttatggtcattcctaaaccactctgcttttagcagcgatgcttgatgcccagtgcttcatctaagctggcggtgatgacgcagacgctatgccgtaaacagggcatgttttgcgagggcatctcttaactgggtcagtaatgccgcttgctcttgctgagtacgaaacacgccttgtgttctgccccaaaccgggcccggccatgccatatcatgggtaaagcgcgcaatatgatggatgtgcagttgtggcaccatattgcctagagcacctaagttgagtttgtctggggaaaatagagtttccagagtttggcaaaccagctgcgattcgactaaaaactgctgctgctcatccattggcagatggtgtagttcacgtaaatccgctctttgcgggactaaaataacccaaggcacggcagaatctttatgtaacagagcaacacagagcgggaaatggccgatcacatcggtgtctttttgcaattggggatgcagttcaaaatgcgccatcagatacgcctccaaatcgatttttattcttggttgaagactggttgaagccagataagtgataaagaaaaggttggcgattggccaaccttttctctacttcaattacattctctctagagtgtcaatacccagtagagcaagaccttgcttgatggttttcgctgtcagtgcagcgagtttcaaacgactctgcttaatgctttcttgctctgcgaccaaaattggacaagcttcgtagaagctagagaaaatgccagccagttcaaacaggtagctacacatgatgtgcggttgaccttcacgcgcgaccgattgtaccgcttcttcaaactgcagcagtttggcgatcaaggctttctctttctcttcagtaatttggatatggcctgttagctcattcatatccacacccgctttcgcaaaaacagaagcaacacgagtataagcatactgcatgtaaggcgcggtattgccttcaaatgccagcatgttgtcccaatcgaacacataatctgtagtgcggtgtttagaaagatccgcgtacttcacggccgccatcgcaaccgtattggcgatgttggctttttcttctgcggataactctggatttttcgattcgatcagggccttggcacgctcttgtgcttcatccagcaaatccgccaaacgtacagtgccgcctgcacgagtcttgaatgggcgaccatctttacccagcatcatgccgaatgcgtggtgctctaagctgacgttttctgggatataacccgctttgcgtacgatagtccatgcttgcatcaagtgttgatgttgacgtgagtcgatgaagtacaacacacgatctgcgcccagtgtttcatagcggtatttagcacaggcgatatccgttgttgtgtacaggaagccgccatcacgcttttgaatgataacgcccataggctcgccgtctttattcttgaattcctccaagaacaccacttgcgcgccatcatcttccactgccaagcctttggctttcaggtcgctgacaatttgtggcagcatgtcgttgtacatgctttcgcccatcacgttttcgcgagtgagggagacattcaggcggtcgtagttacgttggttttgaatcatggtcacgtcaaccaacttcttccacatctctagacagaatgggtcgccaccttgcagtttcacgacgtagttacgtgctgtttctgcaaactgctcatcttcgtcatacagttttttcgattcacgatagaaagcttcaagatccgaaagctccatcgaaacctcacccgatgctttttgtacgcgctcaaggttagcaatcaacataccgaactgagtgccccagtcaccgatgtggttagctcggatcactttatggcctaagaattccagagtgcgtacgactgcatcaccgatgatggttgaacgcagatggcctacgtgcatctctttggcaacgttaggcgctgagtagtcagccacgatggtttttggggcttcttgtgccacgccaaggcgtgcatccgccagagccgcttcggcttgcgcagccaaaaactcttcgcttaagaaaatattgataaaacccggacctgcgatttcggttttgctcgcgataccttcaagattgagaacatccaagactttttgtgcaaattctcgaggattggtacctaactgcttggcagcgcccataatgccgttggcttggtagtcaccaaattgtgcttttgctgattggcgaaccagtgccggagtgcctgctggtgcgcctgcggcttcaatagcctgagaaactcgatcattgatcagtgcttggatattcacacgtttacccttcaattcaaggaaataggggaggaatgccatcatttttgaagtgaggcatatcacaataatatggtttaattggcggtcatgataacaatattcagcctaaccacctagggtgaaacacaggaaattttcacctttttccgtcaatcttggtagtatcgcgtccaaactggcattttgaggcgaacagatgcaacaacaactttatgcgacagggcttgctccacaacaactgctcgaaaaactcgacgtattcattgccaaaattgagcagttgcttgatcttttaggcttagatctgcgagccaatcagctagaccatattgcgctgcgaatcaacgatccgcaattggcgcaagtcgctcatcaagcttggctcgcttatggtgaagagatctcttgtgcgcagattaatggccgcccgatcatcgtgattcgttttaaccagccactgcaagtgagccattggcaaattgagtgtcttgaactgccgtatcctgcgcaagggaaaacctatcctgagcagagttgggagcatgtagaatttgtgatcccttcacaagctctgagtgcagaggctttttgtgaggagttgaaaggcggttacccctcactggcggaaaaatggcatcagcttaatgaactcggcatcaaagtgaaactgtcgagcccacaaggtgaaggggagcgtttggcgaacccaaccattgcgttccagtggcaaggggggtgtattaagctgcatccacacccgttgcaaaccattgtggaatccgaaagggcctaacccacatcataagctttagggcgcagttggaactcttccactgagccaatttcttggccgagttgtaaggcaggagcctcgtgatgggctcggccttgagtatgcataattaagcgatgtgccgtacgtggtttcagttcattgacaacgaagcgtatcatgtcagcacggctgagatttttaagctcttccagcactttttctcgctgatcgaaactgagatctttattgccaatcgcaacccataaacgctgggctcgaatccggagtgtcgggtcgggcgcggaaatttggttccacaatccccgtttactgctatgccattgatattcattgagttcaagcagaaccatatacaaggcatttaaaaactcatcaatagagcggatcaattcacttggcggagccgatggtgattgaacgtataagattaaacccggatggcggtttaatggcatattgcccgtaccaaccatataaccgagttgctgtttggtgcgaatttcgtggaagaaggtggccgacatcagatgattggccagcgagtaaagcgcaatactgcgtgggctgacttcatgagattggtaatacaccacaatcgcggaatcatcttgttggcactgtacttcacgttgaaacgttccactctttccgagcataaccaatgggcgaagcgactcttcataagtttgtccttgaacgcgtagcgcgtctttgagcacttccgccatcttgtgggcttcggcggcaggccagtcaccatagacaaacatttcgacgtgtaactgcgacagaattgtgtcgacaaaatgggctaactcttccacttgtacatcatcaatcgcggctagtaactcggcataaggtgggttattgggttgcaataacccagtcatcgcattaaacagttgagaaatgggtttatcgtgggcggcattgcgccaattacgagtcatttgctgcttgatggtggcaaagcgcttcggctggaaatcgcgctgcgcaaatttacgtaaaatcacttccatcaattgcggtaatttttggctaaaacctgacaacgtgagcgtcacgccaccttggtgggcatagaggttgtagcccatccccgctatttcggcttggtatgtttctttggctaacgcatccaaaaacatctccacacacaaacgggtcatcacgatattacgacagttagccacggcatgcgggctgtcgatcgcaacataaatcacgcctttaggtactctgaattcggtgtcttgctgatgccaaagtttgaatccgggtaagtcctgcaacacttgcggcagagtgtggctctccttgacctctgacgggtcgaggtcataacagataaatgggttgggttcaggcagggagatgggtaaatccaacggctggcggaatctgtgcagttgttcagtagtgaaagggcgaactgaataaggggtaaagtaccattgcgcttttttatcgtactcacccccttttgcaatcaaggtggcacgcaggttctctggggtgagataacttaaaatatgcagcaacaaggcttcatcgtagcctgacatcatatagtccccgtaagccgtatcttcgggggcataatgctgcatgttgaccaccaaatggctgaccatatccagtgggcgctgggtttcttgaaagcggaaagccgactcaagtacagcccgtttttcttgataacgccacgcctgtaagccttgagtcgcaatcaaattcagcgtttggaatagactttgaataatctcatcaacatgatccaatccttcctgagtcagcacacaactgacggcaaactcgcggtagttactgccacttacccctccgccagcagaaagagtagtgatccaacctttctctttcaacgcttccagcaagctgccttcaccctcatagccaattaaatgcgcaaaataagagagcggttttttctgatagtagctttcagtgctgggcataggaaaagcgaggatcagcttacgaatctctttgagaggctcaatctgaatcaaaattcccgtatgttcgcgatcaacaaaaggagggagcggtttgatatcgcgttgcgggtttgggatcgcggcaaaataacgctcagcccatgcttcgagttcgtcaaaactttgcgagccaatcagggacaacgtcatcaacttggctgaataatgggactgataaaactcaataatttcatctcgaatagagctgttttcgcgatcgcctaaggtgtgctgattgccgactgagaacttgctaaacgggtgctgcggattaatggtttctttttgtacttggtagagacggcgtgactcatctttaattttcagtttgtattctgagtcgacggcttgacgctctttatccaaagcctcggcattaaacagcggtgcgataaaaaactgactgaaacggtcaagcgctttagcaaaagcgttcggcaaaacatcaaagaagaaacaggtatgttctgtgccagtccatgcattattagaaccgccatgctgactgataaaagtttgaaaatcgccaactttcgggtatttttctgtgcccaaaaacagcatgtgttcgagatagtgagccaaaccttggcgttcgataggatcgtcaaagtgcccgacgttgaccgctaacgccgcggcgcacttttgaacatcagggctttggatgagtaacgtccgtaagccattgctcagcgtaatatatcggtactgatgagtatcattggggctgatatgcacagcatttctccggattggtagggtcaaagacgagtcacagaacaccaaactgacacatcgtactattattattcctgtcagtttagtctgtcgcttggctttttaatagactgttaacgaagtcgaagtctttgctcagactgctgttataatcaaaaaaccaagcagccagagactgcatagcgtaggtagtgtacatgaagatttatattatgcgtcacggtgaagcgcagcagtttgcccctagtgatgcacaaagagcattaaccgaccgaggccgtcatgaatccgaagctgtcgcgcgcgcatgcgtcaatcaacggggcgtgaagggtttcgatcttgtgttggttagtccttacttacgggctcaacagacgtgggaactgctcacggatcatttttccgccaaaagagtggaaacttgcgatggcatcacgccctacggccagtcggatcgagtatttgattacctatcggccttgattgaggttgaacagctcgaatccttgttgctggtttcacatttaccgctagtggggtatctggtatctgaatttgtggccgatatgattccacccatgttcccgacttcaggaatgatttgtatcgattacgaccccatagcgcagaatggacagcctttatggaatgtgcatccgtaaccctatttcccatcatttatcgtgtatatcgagagcctccagcagctctcgttgtttttaaggctttgttttttcaggcaagatgccttaactgaaattgccataaaattgacgtagggaatggactgaaaattgcatcaacgcgatatacgttttctacttgaagctgcaactgcgctggttacgctcgttcacccaagcatagagtgagtctatactcatggggtttttcctacggcggccgaactgcaactccaagtcgtttggttatagcatcgctacggcgcagccttgatgttccgattaacccttcagtgacagccagaaatttatgaaatttacaatgccatttgcggacaaattgccttcaattccacagcgtagcatgcctgcgatcggtgctccggtcatggtattggccgcattggcgatggttgtcctcccaatgccagcctttctgctcgacttgttcttcactttcaacatcgctctgtcgttagtggtgcttctagtcaccgtctatacccgtaggccattagattttgcggcgtttccaacggtactgctgatcgcgaccttgctacgcttggcactgaacgttgcgtcaacgcgagtcgttttgctgtacggtcatgaaggtccaggtgcggcgggtaacgttatcgaagcgtttggtaacgtggtgattggtgggaattacgcggtcggtttggtggtgttccttatcctgatgatcatcaactttatggtggtaaccaaaggtgcgggacgaatttccgaagttagtgcccgctttaccttagatgccttgcccggcaagcagatggcgattgatgctgacttaaacgcgggcttgattgaccaagaacaagcacgtgtgcgccgttttgaagtcaccaaagaagcggacttctacggttcgatggatggtgcgtcaaaatttgtaaagggtgatgcgatcgccggtattttgattctttttatcaacatcatcggtggcctgagtatcggaatgatccagtatgatttgggtttcaaagaagcgatcgaaatctacaccctgttgaccatcggtgatggcttagttgctcaaattccatcactgctcttatcgattggcgctgcgattatggttacgcgtcaaaataccgatgaggacatgggacagcaggttatcttccaactgtttgataacccgaaagctctcaccattaccgcaggtatcctgtttgttatggggattgtccccgggatgccacattttgccttcctgtttttagcgctactggccagtggtgcggcgtattggctgcaccgtaaacagaaaaccaaagcggagaataaaaatctgcccgccaagagcgatgtggaaaccccgacccaacgtgaactgtcatgggatgatgtacagccggttgacgtgattggtttggaagtgggttatcgcttgatccccttggtggataaagatcaaggtggcgagctgcttgaacgcgttaaaggggtgcgtaaaaaactgtcgcaggactttggtttccttattccaccggtacatattcgtgacaacctagaattaacgcccaatagttaccgcatcaccttgatgggcgtagccgtgggtgaagcagaaattcggccagatcaagagttggcgattaacccgggacaagtgtacggcatgattgatggtgagcgcactcgcgacccggcttttggtctggatgcagtgtggatacgggaagatcagcgtgagcatgcgcaggctttgggctataccgtggtcgattcttccactgtgctcgccactcatcttagtcaactgctcaccaacaatgcggcacagctgattggccatgaagaagttcagaatctgctggaaatgctctcgcgctccgcgcccaaactggtggaaaactttgtaccagatcagctttcgctgggggtcgtggtcaaagttctacagaatttgctgcatgaagcgatcccgatccgcgatattcgcaccatagtgcaaaccctttcggaatacgcgagtaagagtcaagaacccgacattttaactgcagcggtgcgcatctcactcaaacgacttattgtccaagaaatcaatggggtagagcctgaattgcctgtaattaccttaattccggagctggaacaaattttgcatcaaactatgcaagcttcgggtggtgaatcagcaggtattgagccgggactggcggaaagactgcaaatggcgctaagccacgccactcaagagcaggagttgaaaggggaacccgcagtattgctgacatctggcgtattgcgttcaacgctagcgaagtttgtgaaaaacaccattcccaaccttcgcgtgctctcctatcaggagatccccgatgagaaacaaattcgaattgtgcaggccgtgggtaattaatcgtccgcacgttttttaaagacggaaatctgctttgaaaataaaacgattttttgccaaggatatgaaaactgcgctgcttcaggtcaaagaagagctgggcgtggatgctgtgatcatgtcgaataaaaaagtcgcgggtggggtcgaaattgtggcagcggttgatggcgatactgcgcccgcaccagccaagcgttacaactcgcagcctagacatggttataaccaagtctcaccctcggtcgctccgaccaagagcagagagctggcggatgaccgtgtcagtttgcaatcgagcgccgactctggccgttctatgactcaacgctttgctaatatgctcaagcaatacagctcggcagatgagcaagagcatcgtgcggaaaacgaagattcgctctctgcgctgctcaagcgccagtcagaaaatcgtgcgccacaacgtaatcagacacaacgtagtcagagtagttcagagcgtcaacgtcctgactctccgctcggtaagttgctgcaagaagatgccgatgcacgccgtaagcctagactcgatccgactcgttatgatcgaaaagtgcctgaagagccgatggtcgccgtcagtgaattagaatcgatgcgtgaagagatgacctcgattcgccgtttgcttgagcatcaagtttccggattaatgtggcaagaagtcgagcgtcgtgagcctctgcgtgccatgttgatcaaacgcttagagcgcatgggtgtctctttggaaatggcggaccaattggcttgctatatcccagaggaaacgcctcctcccaaagcatggaaagcattgttaggtttagtctccgaccaaattccagtcgtcaaacacgacatcctaaagcgtggtggcgtggttgccttacttgggccaacgggggtagggaaaaccacaaccgtggctaaattggcggctcgtgcagcgatggaatacggctctgacaacgtcgcattggtgaccacagacacttaccgtattggcgcccatgagcaattgtcgatttatggcagaattatgggatgtcctgtaagagttgctaaagattccaacgagttagccgatgtaatctatcagctgcgtaatcgtcgcctgattttagtcgataccgcagggatgggacaacgcgatgttcggttgtcagaacagctggataccttgatgcaagagagcggagagactatccatagttaccttgttttgcctgcgaccgcgcagcgcaaagtattacaagaaaccattgagcatttcagaaggataccgctttctggatgcattatgaccaaactcgacgaatgtttgagcctaggcgaattcgtcagtgtggttgtacaaaatgcgttgcccgtcgcttacatcgcgaatggacaacgagtgcccgaagatatcgtaatcgcgcaacccaaatacatggtcgcaaaggcaaacgaattgctagagaagtcgactgaagatgaacctcattactggaccagtgattcagagagattctaggcggcggacaggtatgacaaacaaaatgatatatgaccaagcaagcggcctacgtcgcttaacccaaccgtcagtgaccaaagtaatttcggtcactgggggtaaaggtggtgtagggaaatcgaatgtcaccttaggcatggctatctgtatggcaaaacagggcaaaaaagtcatggtacttgacgccgacttgggcctcgctaatgttgacgtaatgctcggcattcgccctaaacgtaacctaggccatgttttagccggagagtgcgagctcaaagatgctattgtggaaggcccacatggtattcgcatcattcccgctacgtccggaacgcaatccatgaccgagctctctcatgctcagcacgtgggactgattcgtgcatttggcacgttagaagatgagatggatattttgctcatcgacaccgcggcaggtatctcagatatggtggtgagcttctcacgcgcagcgcaagatgtagtggttgtggtgtgtgatgaaccgacctcaatcacggatgcgtatgccctgatcaagctactgagcaaagaacatcaagttcaacgatttaaaattgttgctaatatggtgagaagttatcgtgaaggccgtgaattatttgctaaattaacattagtgacagaacggtttttaaatgtgagcttagaacttgtcgcctgcatcccactcgacgacaatgtacgccaagcggtgaagcgacaaaaaatcgtggtggatgcgtatccacgctcaccagccgcattggcgataagctcattggcaaacaaagcgttgacttggccgataccgagaacaccaagtggacatttggagtttttcgttgaacgcttacttaatcggtcagaaacagtaggggaacctttcggtgaataaagcgcttacatacgatcaatacggaaatcttaatagccagcagctatttcttgagaagtactctgtattggttaagcgtatcgctcatcatttgattggtcgtcttccgcccagtgttctgatcgaagacctcattcaagctggcatggttggtttgcttgaggcacaaaaaaattatgatggaagtaaaggcgcgagctttgaaacctatgccggaattcggattcgtggggctatgctcgacgatatccgacgtggtgactgggttccgcgatctgtgcacaaacataatcgggaaatcagtcaagcgattgcagtgctcgagggagaactcaatcgcgatccaacggatgctgaagtggcgaagtttttaaacatgtcactagagcagtatcacagcgtgctgatggacattaactgttcacgtattgttgggatagaggatctcggtgtttctgacgacgcgatttcaccgtttgaagagggggaagataactcgccttttcacggtgtcgctgaagaatctttccgtaaagcactcgttgaatcaataaaatcgctcccggagcgtgaagctttggtactttcgctctattatgatgaagagctaaacttaaaagaaattggtgaggtacttggagttagtgaatctcgcgtcagccagatactcagccaatctatgcagcggctaagaacaaagttaagttcttggactcggaatgactaaatatcactgatctcaaactcagtggaggcaattttgaataaaaacatgaagatccttattgttgatgacttttcaacaatgcgccgaatcgttaaaaacctacttcgagatctggggttcaataacacgcaggaagcggacgatggcctaacggcattgcctatgctcaagaaaggtgattttgactttgtagtcacagactggaatatgcccggtatgcaaggtattgacttgcttaaaaatatccgtgccgacgaagaactgaagcacctgcctgtactaatgatcacagcagaagccaaacgtgagcaaatcatcgaagccgctcaagcaggcgtgaatggttacatcgtaaaaccatttaccgctgctacgcttaaagaaaaattagacaaaatttttgagcgtttataaggcttttgctgcggcaaaaggtgctctattcacacgcgcaaaaggctgattcaggatgatttcattagaacaggctaaagaactcgtgcaacttttggaacaaggacgtcaagacgacgctaatcgccttttcacctatgtctacgagtctgccaataaccctatgtttaaagagatagggatgctgacgcgagacttacacgaagcgctgaaaaactttcagattgatgagcgcttcagtgaaatcgcgacggatgaaattccagacgcacgggaaagactgcattacgttatacagaaaacggaagtcgcagcgaacaaaaccatggatgcagtggatcggtgtatgccgatagccgacaaactacatgaaagcttgctgctgattcgccctgaatggaatggcttgatgaatggtcggattgaactgatgcacttcaagtcactatgccaccggattgatgacttgctctcgcaagtagaaggcgacagcagtgaattgcgtggtgaattgactgagatcctgatggctcaagactttcaagacctgacaggacaaatcatcaaacgtgtgattaatctggtcaatgaggttgaaaaacgtttagtcgaaatactgacggtttttggcgcagcgcaaaaagaacaaaaagcagacaaggcgacagtggcatcaatagaaccagaggggccgattctcaatcctcatgaacgaattgatgctgtctcatctcaagacgaagttgacgatctgttatcgagtcttggattttaggggtaacgtatgagctacgaattagacgaagacatcctgcaggactttctggtagaagccggcgaaatattggagttgctttccgagcagctcgttgaactggaaaacaatccagaagaccgagatctgttgaacgccatattccgtggttttcataccgtaaaaggcggtgctggtttcttggcgttatccgagctagtggagacctgccacggtgcagaaaacgtgttcgacattttacgaaatggtcagcgacacgtttctcctagcttgatggataccatgcttaaagcattggatactgttaatgaacaatttcgtgctgtacaagagcgtgaaccactgcaacctgccgaccctgaattactcgatgaattgcaccgtttaagtaagccagcctcagaagacgaggatgaggctgcagaagcgcacttcgatgagccagaagaagaactggttgaagagattatcgaagaagtcgttgaagacgttgttgaagaggcagtgcccaacgtcgagacggaggttacagcaagcgcatccagtggtgtgattgataaaggctctattgacgatatcaacgaagatgagttcgaaaagttgcttgatgaactgcatggtaaaggcaaggctccgggagctcagtctccgcaagctcccgcttctgcgccagcgaaagccgcatcagtaaccaattctgatctcaacggtgatatcacggacgatgagtttgaaaagctacttgatcaactgcatggcaaaggcaaaggcccatcgattgagacagcagcgcctgctgctcctgtaacaccatcgacgcctaaagcgactgagacaccgaaacctgcagctgcaaaatcagcgcccggtggcgatgacttaatgaccgacgaagagtttgaaaaactactggatgagctacatggttcaggcaaaggcccatcagtagaagagctagagatggctactcgtccagtggcgtctagccctgtttctagtgatgcgaaagcttccgccgaggcgagcgcgccttctactaagccagcagcgaaacctgttgcgaagcctgcagcggcaaaacctgctgtggctaaagaggaaccagcaaaagctccggctcctgctgcggtgaaggattctgatgaatctcgcgaagtggccgctgctggtggtgctaagaaagcacaaactgaatctactgttcgggtcgatacctcaacacttgataccatcatgaacatggtgggtgagttggttctggtacgtaaccgactcttgagccttggcctgaatagtaatgacgaagagatgtctaaagcggtggctaacctagatgtggttactgccgacttgcaaggcgcggtgatgaaaacgcgtatgcaaccgatcaaaaaagtgttcgggcgtttccctcgcgtggttcgtgacttggcgcgtagcttaaataaagaaattgaccttgagttacgtggtgaagaaaccgatctcgataaaaaccttgttgaagcgctagccgatcctttgatccacttggtgcgtaactcggttgaccatggtatcgaaatgccggacgagcgtgctaaaaatggcaagtctcgtacaggtaaagtgattttgtctgcttcacaagagggagatcacatacagttagctatcgtagatgacggtgcaggtatggatcccgataagctgcgtggtatcgccgttaaacggggaataatggatgaagatgccgcgaaccgacttaccaataaagaatgctttaacctcatttttatgcctggtttttctagtaaagagaagatcaccgatatttcagggcgtggtgtggggatggacgtagtaaaaaccgctatcaatacactgaacggctcgatcgatattgactctaccatgggtaaagggacaaagatcaccatcaaagtgcctttgactctggctattcttcctaccttgatggttggcgtcgcggggcatccgtttgcactgcctctggctagtgtgaatgagattttccatctggatttacgtcgtaccaatgtggttgatggtcagttgactatcatagtgcgcgaaaaatcaattcccttgttctacttacaaaactggttagcaccgaagaaaggcaaagtacagcttcgccaaggtcatggccatgtggtgattgtacaaatcggcagtcagcgcgtaggtctggttgtggataccttaattggtcaagaagaagtggtgattaagccactggataaattgctacagggcaccccaggtatgtctggtgcgactatcactagcgatggtcatattgctctgattttggatgtgccggatctgctcaagcagtatgcagctgcttctcgcgtctgattagctgcacaacgataaggataaacatggcgattaaagtattagttgttgatgattcgagttttttccgtcgtcgcgtgagtgaaatcatcaactccgaatcgcgcttagaagtcattgatgttgctgtaaatgggaaagaggccgtagaaaaggccgctcgactcaagccagatgtgatcactatggatatagaaatgcccgtcatggacggtatttccgctgtccgagaaatcatggcaaacaatcccgtgcccattttgatgttctcttcattgacccatgatggcgcaaaagccacattggatgcactggatgctggcgcgttagactttttacctaagaagtttgaagatatcgcgcgcaaccgggatgaagccgtcacactgttacagcagcgtgtgctttctattgcatcgaaaaagatgtttctacgtcgccctgcagctccacgccctgcgcctacaacatcaatagcagcgagttcgtcactcagccaagaacgagcggcagctacctcacctttgggaaaccgaccctcgacggcggtttcagcagccactcgttttaaagcttcgggtaaaaaataccagttgaccgcaataggaacctcaaccggtggacctgtagccttgcaaaaaatattaactaagctccccgtaaattatccacaccccatagtgttgattcagcatatgccagcaacatttacggctgcttttgctagccgtctcaattcgctatgcaaaattgaagttaaagaagcggaagatggagatatgctgcgtccgggtgttgcttatttagcaccgggtggtaagcagatgatgctggatggtcgacccggtgcggctcgcctacgtattatcgatggtggcgaccgcatgaactataaaccgtgtgtggatgttacttttggctccgcagcgaaaatctttggtgacaaagtactgtccatgattttgaccggaatgggtgcggatggacgtgaaggtgcgcggatgctgaaacaagcaggagccaccatttgggcacaagatgaagaaagttgtgtcgtgtatggcatgccacaagctgtcgctaaagcaggaatttcaacggaagatctaccgctggagagaatcgcagagcgtatgttggtagaagtcgggctcgcctaaggaacctcaatgatcgtttggagtgtagcaaaccaaaaaggtggggtaggaaaaaccaccacaacgattacattggcaggcttattaagccagcagggtaagcgtgtcctgctggttgataccgatccacatgcctcactgactacttatttggggtacgattctgatggtgtaccagccagtttattcgacttgttccagttacgtgaatataacgaagcttctgttaaacctctgattttaaatactgatattcaaggtattgatctgatccctgcccatatgtctcttgcgacactggatcgtgtcatgggaaatcgcagtgggatggggctgattttaaagcgtgcactgctcgcgctgcgtcatgtttatgactatgtactgattgattgcccacctattttgggggtaatgatggttaatgcgttggcggccagcgatcgtattcttattcctgtgcaaaccgaatttctggcgatgaaaggtctagagcgtatggttcgcactttggcaattatgcagaaatcgcgcagccgtgagtttaaagtgactatagtgccaaccatgtacgataagagaacgcgcgcttcgttgcagacattgaatcaactgaaaaaggactatccagacaaagtttggacctctgcagtaccgattgataccaaatttcgtgatgccagtttacagcgactccccgcttcgcattttgcagaggggagccgtggcgttttcgcttataagcagcttctgcttttcttagagaggctcgctatcgatgagtagtgcattgatatccagcgaacaagcgctgaacgattattttacggcgctactggatgaagaaacggccgaatttgagtccactctcaagcctgaaccggtgtgggagatggctcctgccatccagtctgtgccaaataaaagttattttgatgcagaaattgaagagcttgagctgcctaatcttgaagatgtgcagcgtttgctcagtcagttggaatcgagtaatccagtagccgatctggatctggaacagattctcgaagaaaacacggcaaaaatcgctaaaatcgaccccgttgttcagccctgcagcgttgttgaagagatccaagagtgggaaatcgaaaccagctatgttgagccggacatcgagacgccagagagtgttattgaagacgatctcgaaccagagtctgtggatactgaggcagagcgtgaaattgcgatagaaaccagcatcgaggaacctgtcgctgaggtaccggttgttgaggcgcaagccgttccagaaacacaagctgggcgcaataaactgggcacttggaccaacacgatccgtgaaaaagatttccaagtcctctattttgatgtcaatggtgtcactttcgcagtgccactcgatgagttaggtgggattcatcgtatgaccacacttaaccatttaattggtcgtccggcttggtatttaggcttacaaaccaatcgagattcacaacttgatgtggttgatacagcaaaatgggtaatggctgagaagctgcgtgatgagagttataagcaagcttatcagtatattgtgatgttgggagaaagtgcgtggggacttgccagcactcaactcatgggcacagagttactcagtacagaaaaagtgcgatggcgtgagcaagtcggtaaacggccttggctcgcgggcatggtgaaagaaaaaatgtgcgctttgatccatgttcaagcattgatagctatgcttaatgcagggcttgatgtaaaagcactggaaaattaaaacattgggtgtcggaaacgactcagagagggaaaggtatgtctcaggcgaatgaagtgaaagtcagaaaagaaaagtcgaacgatgaagtacttcaatgggtgacgttccaattggaagaagaaacgtacggcatcaacgtaatgcaggtacgtgaagtactgcgctacaccgaaattgctcctgtaccgggagcgcctgactatgtattaggtattatcaacctgcgtggtaacgtcgtgactgttatcgacactcgttcacgttttggtttgatgcaaggcgaaattactgacaatacccgcatcattgtgattgagtcagaacgccaagtcatcggtattctggtagatagcgtggccgaagtggtttacctacgttcatcagaaattgactcaaccccaagtgtgggcaccgatgaaagctcgaaatttatccaaggtgtgagcaatcgtgatggcaaactactgattctggtggatctgaacaagttcctgaccgatgaagaatgggacgaaatggctcatatgtaatggttgatttgatttggttaacccctcctgtaatcgcaggagggtcggtttttgttgttttgtgcatcatgctggcattgtggcgtcttaaacgtggtcagcatcgtcaaagtgaaaccttgcgccaacaaattcgcaatctggatcgtgagctgcagaaatccaacaaacaactgcttgaagtgcgttcggtgatggtcgggctcggacaaaaagtcagtgagcaacaagatatcattcgccatctcaatgagcgtttacttgagctggaaaatactgacgcggatgcgcgtttgtacactcgtgccagtaagatggtgcaacttggtgccgatctcaatgaactgatccaagagtgcgagctgcccaaagccgaagcggaattgatgatgtctttgcaaaataaactggcgggtaaggaatcgattcctccgctggaaagtcatcccgaagttcgagccaacaaagccaaatcatagtatggcttatttccttgaagcctactggtagccaacatgactacagcttcaattaggaaaaagatattcatttggatatggctcatgactgaatgagtttttgaaggaagcgtaggcttcctttttttattcttcatcgacaggaacggatgaatcgttgagatgagggtttagcgcgtttgatattgtgatatcacgcatgtttctcgttatggatggattatagttgtaactacaaagggttagatgcgaacaaaacgcgtgaatttttaatagattcttacttagtttcgtgattagtaatagagttcgcgtctttagtctccccctcgctgtgttaatatagccgtcccaacgctcttagtagataagcatgttagaagttaaaaatctcaccgccatacgtgatgaacggattttattcgaatcactctcttttgagatccatgctggcgaactagttcaaatcgaaggtcgtaatggcacaggcaaaacgaccttgttacgtattattgcgggtcttggagagtgtgagtgtggggaaatcctctggcaacggagcaaaattcaaagtgaccgcgaaagttatcatcaagacttgctgtttttaggtcatcaaaccggcatcaagcgagaactcaccgcactggaaaatttacgtttttatctggcggttcatcaacaaacggtggatgaccccgcgatttttgaagcgctagccaaagttggtttagctgggcgtgaagatgtgccggttgcacagttgtcggcagggcaacagcgtcgagttgccttggcaagattatggttaagtaaaaagccactgtggattttggatgaaccgctcaccgccatcgataagcaaggagtgagtgtgcttgaggcgctctttttaagccatgcgcagcaaggggggatagtgatactgacgactcaccaagacatgtttgccgataaccctaaactgcgcaaaattcgcttgggtgatccgaaatgatgcctgcttttattcagtttattcatcgtgaacttttaattgcttttcgccgtcaggcggatgtgtttaaccctctgtggttttttatcatcgtgattaccctgtttccgctcagtgtgggaccagaacctgccttgttggcacgaattgcgccggggattgtttgggtggccgctttattagcggcattgctctcattggagcgtttatttcgtgatgattttcaagatggtgcattagagcaagcgatgctgacaccattaccgctctcagtggtggtactggctaaggtgacggctcattggctactgacaggcttaccgctgattttaattagcccactactggcgatcttgctttcatttgatagctcagcctggcttgcggtagtgctgactctgttgctggggactccaacactgagttttattggggcaattggggtggcactcaccgtgggtttgcaaaagggtggggtgctattgagcttattggttttgccgctcttcatccctgttttgatatttgcgacctcggcgattgatgcggcggcattgggaatgccgtataacggccagcttgcgattttagcggctatgctcatgggttcgatgactctaacgccatttgcgatcagcgcggcgttacgagtaagtgtgcattgattgttttcgatcaagcacgaaaatactgcgttagataaattataacaacttagttaaaactcaataatttgaaagcaaagtgagataaacatgtggaaatggcttcatccctatgccaaacctgatgccgcttaccagctgtgtggtaagttgttgccttggtttgccagtttaggattcctgtttcttgcggtaggaacggtgctcggtttggcctatgcacctgcggattaccaacaaggggacagttttcgaatcatctatatccatgttcccgcagcgatatggtcgatgggggtttacatgtcgatggccatcgccgcatttatcgggatagtctggcaactgcgtatttcggatatggccgcgttagccatggcacccatcggcgcggtgtacacctttattgcccttatcactggtgctatttggggcaaaccgatgtggggagcctggtgggtgtgggatgcgcgtctcacctctgagcttgttctgctgtttctctatttaggggttattgcgctttatcatgcgtttgatgaccaaaaaactgcggcaaaagcggcgggtatattagccatcgtcggagtgattaacctgcctatcattcacttctccgttgagtggtggaacaccttgcaccaaggtgccacgatcactaagtttgccaaaccatcgatcgcaccagaaatgttatggccactgctcgcttgtatcttgggttttgcgttcttttttgctgcattgaccatgatccgcttacgcaatgaaattttgagccgagaaagccaccgtccttgggtgagtgagcttgccaaccaaaccgtgcgaggaaatcggtaatgcattttgactctttcagtgattttttagcgatgggcggttatgccgcttacgtttggagtgctttcggtttgacttatctttccatggcgatgttgtggatcgtcagcgttcgacgcaaaaccaagttactcaaccaagtgcgcgataaattggcgcgtcaggcgcgtattgatgctgcgaaacatatggagaacacactatgaacccaagacgtaaaaagcggctcggtgttgttttggccattctatttggccttagcgcgaccattgggctcatcatctatgccttgaatcagaatatggatctcttctataccccgactgagctcgtgtatggcaaagaggggaaaaagccggaaatcggccagcgtttacgtattggcggtatggtggtggaaggttcggtaaaacgtgatccgaactcattgaaagtcagctttgatctacacgatgtgggaccaagtattaccgtgacctatgacggtattttgcccgatctgttccgagaaggtcagggtatcgtagcacaaggggtgttagtggagccgaccaaaattgaagcgtttgaagtgctggcaaagcatgatgaaaactatatgccaccagaaattgcagaggcgatgaaaaagacccacgctccactgcaatactcgcaagaacagaaacaaggaagcgaccaatgattgctgaaattggccactttgcactgattgtatcgctcagcttagcgatattactcagtgtgctgccattagttggggcgtcacgcaacaacacactattgatgaacacggctcgccctttggcatggggtatgttctttttgctgtcgatctcgtttgcggttttgctgtgggcattctatatcaatgattttacagtgcaatatgtggcaagtaactccaatagtgagctgccttggtactatcgcctcactgctgtatggggcgcgcatgaaggttcattactgctttgggtgcttatccaagcggcttggactgtggctgtcgcgagttttagccgcggtatgccacaagaatcggtagcgcgtgtgcttgcggtgatggggatgattactgttgggttcttactcttcatcattctaacgtctaacccgtttttacgcaccttgccttattttccgattgacggccgtgatttaaatccgctgctgcaagaccccgggttaatcattcacccgcctatgttgtacatgggatatgtgggattctccgtggccttctcgtttgcgattgcttctttgatgacaggccgtctcgacacggcatgggcacgttggtcacgaccttggacaacggccgcttggctctttttgacgctgggtatcgtactgggttcatggtgggcttactacgaacttggctggggcggttggtggttctgggatccagtggaaaacgcctctttcatgccttggcttgccggaacagcgctgatgcactcattagcggtgactgaaaaacgcggcacgttcaaagcgtggacggtactgctggcgatttctgcattctcgttgagcctattgggcaccttcttagtgcgctcaggcatcttggtttcggtgcatgctttcgcctccgatccggcgcgcggtatgttcattctcggcttcttgattgcggtgattggtggttcactactgctatttgcgatcaaaggcgcttcagtacgagtgcgtggtaattttgagctggtatctcgtgaaaacagcttgttggtaaacaacgtgctgctgatgaccgcactcgcggtggtactgattggtaccttgttgcctttagtgcacaaacaactgggtcttggttccgtctctatcggtgcgcctttctttaacatgctgtttgcctggttgatgattccttttgcattttttatgggaattggtccactgatccgctggaagcgcgatcaaatctccacactctttaaacctatgctcatcacagcgatggcatcgttagtattggcagcgttgatgatgtggctgaatgctccgacgtttagcccaatggcttatcttggttgggtcatggcgtggtggatcttactgttacacgcttatgaactgcacacgcgagcgactcatcgtcaccgcttcatagttggggtgaagaaactgcaacgtagccactgggcgatgatgcttggtcatgttggtttagcggtgagcatcattggtattgctatggtgcaaaactacagcattgaacgtgatgtgcgtttggctccgggagataacttccaactcaatgagtacaacttttacttccaaggtgtgcgtgataaagatggaccgaactacgatggctacattgctgattttgaaatcactagccaaggccaatatgtcaatacattgcatgccgagaaacgtttctatcgcaccgcaaagtcaatgatgaccgaagcggcgatcgaccgtggcattacgcgtgacctttacattgcgatgggtgagcgtttggatgataaccgctcttgggctgtgcgtatttattacaaaccttatgtgcgctggatttgggcaggcggcttgctgatggccatcggtggtgccttagccatcagtgacaagcgttaccgctttagaaaaaacgcacatcaggaggcttaagtgaataagaagattttatttatcccgctagtggcatttttgctgttggctggtgtgtttgctacccagttaatgaaaaactccgcaggggatgacccaaccaagttggaatcggttttggtgggaaaaaccgttcctgagtttcgtctcgaagatctggcagagcccggtaagttatacgatcagtcgattttcaaaggcgagcctttactgcttaatgtatgggcaacctggtgtccaacttgttatgccgagcatcaatatctcaatgagttggccaaacaaggggtaaaaatcatcggccttaattataaagatcagcgagataaagcaactcaatggctaaatgatttaggcaatccttacctgatcagcttgtttgatggcaatggtatgttgggactggatcttggggtgtacggtgctccagaaaccttcttaatcgatgccaatggcgtgattcgctatcgtcatgttggggatgttaattcgcgcaactggcaagaaacactcgcgccactgtatgaaaaaatgctggcggaggcgaaacaatgaaaaagtggttgtttgcggtctgtgccgccatgctgatttctctctcggcgtttgcaacgattgaagtgtatgactttgataccccagagcaggagaaacaatttcaagaattgggggcgaccttgcgctgcccgaaatgtcaaaacaacacgattgccgactcaaacgctgagttggcacaagatctgcgccaaaaagtgtatgagatgaccaaagagggtaaatcgaaatcggaaatcgtcgactacatgattgcgcgttatggcaactttgtgacctacaatccgccatttaccttaggtaccgctgttctttggcttgggcctatttcagtgttagtgattggtttcactgtgattgtgttacgcagtcgtcgtaaagcgcgtgatgctgcgaataatgccgagtggaatgaagagcaagaagcccgtttgaaagcattgctaaaagaagagcaagagggagagaagtaatcatgtggatgttttggatctcgaccctattactggtggcgattgcggtggttttcgtcatcattccgtttattcaaaagcgtgcgaataacgatcaggctttgcgcgatgagctgaataaagcgttttacaaagaccgcttgaaagagcttgaagaggaaaccgaagaaggcattgttgccgatcaacaagatttgattgccgacttaaaacagactctgcttgacgacattccaacccagcaaaaacatcagcaggaaaatcgtgtttcactgtggatggttgccctgccttcagtattgttggtagtcggattgagttatgcgctgtacgccaagtttggtcactatcagcatgttcaggcttggcagcaagtgtcagcacaactgcctgaattgtcaaaaaaactcatgtcgccacaagcggaactcagtgacgaagagatgaatgatttgacgttggcactgcgcactcgactgcattatcagcctgatgatgttaccggttggttgttgctgggtcggattggccttgctaatcgcgatctggaaaccgcgattggcgcgatgaagaaagcttttgctctggataatgaagatccggatgtgaaatttggttacgcacaagctttgatgctttcgaatgatcctgtcgaccagcaagaagcgaagtcgattctgctcaagttagcccaacgtggttatgctgatttacgcgtctattcattattggcgtttgatgcttttgaaagtggagattttcctgctgcaatcaagtactggagtttgatgcaacaagcgattggtcctgacgatgctcgttatgagatgctcagccgcagtattgaaagcgctcgtaagagaatgggcgagggcatggcagagggtcaatcggtgaaagtcaccattaatctaggcgagcaggttaaggttgatcctaacgcagtgttgatcgtatctatccatgctcccggttcgccaatgcctgttgctgcagcccgttatccgctaggtgagtttccaagaaccgtggtgttggatgacaataacagcatgatggaaggatcaaaattgtccagtcttgagtcgtatgtggtacgtgtgcgtatcgacagcgatggtaatgtggcgacgaaaagcggtgactggtatgccgaaagtcccacaatgaaaacaggtgagcctgttgacgttgtgcttgataagcagtatgaataaaatcacaagctgaaaaataatataacaataaggccgatgggatcatcggcctttgcacatggaattacgtatggttggccgcttatcttggattacgctattcacactttttttagttgggtgcagcagtgcacctgatgactcctcccctcattcgcaggtgaacgatcctctggaaagtttcaaccggcaaatgtggacaattaactatgactacctagacccttatgtggtgcgtccggtctctctattttatgtcggttatgtacctaagcctgtacgcagtggcattgccaacttcctctctaacttagacgagcctgccagcatggtgaataacctgctgatgggcaatgggacaaaagcggtcgatcactttaatcgtttttggattaataccagctttggtttactcggtttgattgatatcgcttctgaagcaggcatcaaaaaatacgatgataaggcgttcagtgatgcggtaggccattacggtgtgggcaatggcccctatttaatggtcccaggttatggtccctatacggtacgcgaagtgaccgatgtggtggatggcatgtatttcccgcttgcctatctcaatatctgggctggggtcggcaaatgggcacttgaaggcatggaaacgcgcgctgcgttagtttcgcaagaggccttattacaagactcacctgatccttacagtttggctcgcgatgcttatctccaacggcaagctttcaaagcggagatccaagtggatgactatgaccctgaggaagaagagtatctcgatgagtatttaaatgaagggttatgatggtctctgaaatcaggctgacataaccctgccgctaaagtattcattggaaacaatatactctgtattacggatcagctcttcccgcatttctgaccagtgtacgatttcatcgttggcgctagcgatttgagggacaactccccccactcgaatattaaatggggtaagctcttgagcccagctctgagtaaaccccgataccatcgaattggcactcacaataccggatctatcttgtactgtgttgtaacacaccacattgacgatgacccctttggtttgccgttggcgcatcctaacagagcaagcatgactgaagttaaacagtgaagacgcaatagccgcgagctgctgaataaactgctcgctaggtttttcatcgaccagtgacggcaatcgcgcagacggtaagttgttgatcagcacatcgggcgcacgctcaaatttttgctcgaccatatcaagcagcgtctcaatactttctggggaaaaatccttgatatgaaagtaggcaacttgatctgagagtgcatgacagcgccaataggtatcgactaatccttgttgatcgcgatcgcagaggatcactttggctcctaacctcacaaaatgtgttgccagtgtgctacccaaggctgagcttgcagaagtaattaatattattgcactttttatgtccatgagtgccaccttaccttatttttatctgcctttttaaccgtgaggtttcgcagggggtttggacagcatggttgattacatgtgtatacagtgtgaataagttcaaataactttggattaaccaaactgaaacttaatactttgcatccattcacaaaaaatattaaacagaattcttgtttgcagtatgccttatgtatatccccttcttacttgaaactcagggcctcagagcgctaggttggttcccaagtgtagagtcactctatacacatagtgctacccagtggccgcttacctgcaactcacagtagtttggacatagagcgaatggctttcttgcagaggagaagaaaggcgagaacagaaggtcaagattaactagcagtacgtagttgatcttggcgataggcggtggcgagacgatgataaaagtcttttgccaatagcgtagagggttgtttatccgcgaggtgacgccgttcgtgccctgagaggttcaagtacacctcttcaggcaaaccttgagtatcctgtggacgataagtaagcacttccggtgtgagatagtggctaagctttgcactggccatgccaccttgatgaaagagtgcggcttgtctggcggagatttgataggagctctcatcattttctaggcgttgaggctctgcgagttcaaaacgctgacgcaatacttgttccgttgtcggtggaacctcaattttatctactggtgtattatcacggacatcattagagaacagggccaagagtaaggcaaagtcggcacgacgcccatgcgtcactgcttggctaattccttggccaaaatgcagttcgctaatgacaccggctttatctaatgtatgaacttgcatgacactctccccttgatgtccatataacggcacaagagcagaaaacttgaggcgaacaaatgaaaaaagcctgcaaaattgcaggcttatgacgatttattaagcagtattagcttattttgctaggttctgagcaacgaagtcccagttaaccagagcccagaaaccattcatgtaatctggacgtacgttacggtagtcgatgtagtacgcgtgttcccacaggtcaaccgtcagcagaggggttacaccttcttcagtcagcggtgttgctgcgtttgaagtgttagtgatcgccagagtgccgtcagcttttttcaccaaccaagtccaagatgaaccgaagttgttgatggctgaatcagtaaattttgctttgaagtcagcaaaagaaccgaatgctgcattgattgcttcagcaactgcgccagttggctcgccaccaccgtttggtgataggcagtgccagtagaaagtgtggttccaaacctgcgcagcgttgttgaaaataccgccagttgaggtcttgatgatctcttctagtgatttgttttcaaactcagtacctgggatcagaccgttcagttttaccacataagtgttgtggtgcttaccgtggtggaaatccagagtttctgctgagatgtgtggttccagtgcgtctttcgcataaggaagagcgggtaattcaaatgccattgctcgattctccgttgagtgtaaagagtggattctctttatgtcattgcttccagtgtattattttcttcgtcgttacgactgacttgccaagtattttagcaactttttactttattaaaagcctgaaggcagaaaaagatccagcaacgccaagtcgagcgtatatccatattgagaatatgctttttattctcggttattcctttagaatgtgcccatatttgatgacatccattaacgaggaagcgatggaaactattgacaaaatcaaacagcaaatcgccgagaacccgattctgctttatatgaaaggctcaccgaaactgccaagctgtggtttctcttcgcaagccgcacaagctctgatggcttgtggtgagaagtttgcttatgtagatatcctacaaaacccagacatccgtgcagagttgccggtttacgcgcagtggccaacgtttccacaactgtggattgaaggcgagctgattggcggttgtgacatcatgctggaaatgttccaaaagggtgaactgcaaactctggtaaaagaagcggctgctcgctcagcaagccaagagtaatactggttaaatttacagttttccttgatttcataaggccacattgagtaatgtggccttaattttatctcgtcagcgatttccatgacccggttatttattgcagaaaaacctagccttgcgcgagcgattgccgatgcactacccaagcctcataaaaaagaacaagggtgtattcgctgcgctaatggcgatatcgtgacttggtgcattggtcaccttctcgaacaagtcgagccagacgcttatgatgagcgatacaaaaagtggaatatggcggatttgcctatcattccagagcagtggcaactgcgcccaagaaaatcctcctctcaacagctcaccgtcgttcgtaagctactcaaagaagcaacgcagattatccatgccggtgaccccgatcgcgaagggcaactgttggtggatgaggtgatcgattattgcaaagtgccgaagagcaaaaaagaaaccgtgcagcgccttttgatcagtgatttaaacctttctgcagtcaagcgtgccttacaaggcttgcgcagtaatcgagagtttattccactctctgtttcggctttagcgcgttcacgcgctgactggctgtatggtatgaatatgtctcgagcttataccctgcttgggaaaaaagccggttatcaaggcgtgctctccgtagggcgagtacagacgccagtactgggtttagtggtgcgacgggatgaagagatcgaacattttatcccgcatgattattttactcttgatgctttaattccataccaaaatggcaccgaatacttcgacatacgtgcccgttggaaaccaagtgaggcctgcttaccttggcaagatgaagaagggcgggtcactaaccgtaaattggtggacaatgttgccagtcgcattgcgaatcagcccgcgactgtgactgaatcagagcaagatcaaaccaagcaagcggcccctttgccctattcactttcagcgctgcaaattgatgcggcaaaacggtataacttcagcgcacaacaagtgttggatctgtgccagtctctttatgaaaagcataaattgatcacttatccgcgatctgattgccgatacttaccgaaagagcatttagctcaggctcccgacgtggtagcggcaatagccaacaatgcgcaagagatggtcaccgcagtgaatgatgcggatttatcactacgctccaaagcgtggaatgacagtaaagtcgacgcgcaccacgccatcattccaacgccgaagaaagcgtcggttaatgcgctgtcagggcatgaaatgaaagtctatcaactgattgcgcgtcagtaccttatgcaattttatcctgcggcgatttatgcagaagccaaactggtttttaacatcgctggcggcatttttattgccaaagggcgtcaactgctcagtgctggatggaaagtgttgaccggtcagcaagatgagcaagaagagtgcgtggataaagtcccccctttgcctgttggcattgtgctgcagtgtcgagaaggggaaataaaacagagacaaaccgagccgccacgccattttacggaagctacattactgcaggcgatgacggggattgcccgtttcgtggccgataaagagctgaaaaaaattctgcgtgagacggatggtttaggcactgaagccacacgagctgggatcttggataccttgtttaagcgtggattactgcagcgtgataacaagctcattaaaagcacgccagctggccgaggtttgattcatgcgttacccagtgaagccacctatcccgatatgacggcacattgggaacatcaactgcaagcgatcgcggaaaaggggcaagcttatcaaccctttatgcagacactacaaggccgcctcgagcagttaattgagcaagttcaggtcgcaccggttcctgtatcattgcaagctttgccagcggtgagtaaacctgcctttaagcgcacacgccgtgcaccaaagagtaaagccagaacgtataaagcttaataaacccagagcagagcaaaatgatcccactgatttaccatcctatttattcacaactggatttgcctgtggggcatcgttatccgatcaataagtatcgcctgctttacgaagagattgtgcgtcaaagagagcaaagtgaagcatggcaagcgagcttcgagtttcatacccccattgcggccgagctttcacgcatcacgcgattgcatgacccagattatgtgcaagctttgctcgaggggacgctatccgcggccaagatgcgtcgaatcggatttccttggagcaaaccactgattgagcgtactttgtactcggtgggaggaacctgcctcacggttgagcaagcgttgcaatcaggggtggcaattcatctcagtgggggttatcaccatgctcacgccgattttggtagcggtttctgtctgttcaatgatctggcgatagccgcgcacttcgcactctctttgcctagtgttgataaagttctgatcattgacagtgatgtacatcatggtgacggcacggcaaccttgtgcgcggaacgtgacgagatcattacgctctcttttcactgtgataagaattttccggcgcgtaagcctgcttctagtatggatgtcggatatgctaaccagacgggcgatgaagagtttttgtccactttcatccaagtggtggaaatggcggtcaatctccatcgacctgatctgatcctctatgacgccggtgtggatattcataacgatgatgagctaggttatttatccatttcacaggccgctatcgcgcaacgagatcgttttatgttgggtttggcaaagcaggagagcattccaatcgcttgtgtcataggcggtgggtatcgcgaagaccatacggcactcgtgccattgcatcttgagttactgaaagcggcgttaagcgcagggtattgaagcgaaatgatggccgtgcgtaaaagcaaaaagccgctgaattatcagcggcttttctaatgtggcggagagatagggatttgaaccctaggatagctattaaccatcgccggttttcaagaccggtgctttcaaccactcagccatctctccgttatggggcgcataatatcgaccctaagttcgattgtaaagccctgaaaatactgtttgcttcaattatgtacacttggccgctatttttatgactaagtgctattttacacattaaataaaacggaaaaggggagtttctaagaaactcccctttaggtgtatggtcggactgagaggatttgaacctccgacccccgacaccccatgacggtgcgctaccaagctgcgctacagtccgatgcgcgtaatctaatgacttttactagatgcgtcaaccctgaaccgacttaaaataatgaatttaattatcttttgcgtaaaaacgctgcaattcggtcaaaccttgcattaatacaggcagtgttgggttggtttctttaagacgttggtaatcgccatcgtagactttgaaattaccaaacttatccaacactgtagtttgtgtatcggtaatcaaggcgagctcacgagcatcgcccgccaaaatccatttgcgcttactttcgttaaacagatttttaccgctgctgtagtcaaccggattagaggaaacaccgagcaaatcttgcatgagtgttaccgagaaatcgagatgactagagcgatgagcataggttcctgccactttgccaggccaatgaatcaccatagggacttgcagttggtagcgactgtagttggtgtttgaaccccaagtattggttttggtttcattaaactccgtgccatgattggaggtgatcactaccacagtgttatccataagtttcaacgagttcagttgttcaagaacggtgttgatgacttggtcggcttgggtcacggacaggttgtatgcactgcgtaaacgatcctccgctgactcttgagcactgctgagttctgaaaactcttctacggtcgtcagttctaaataactaaaccaaggctgtttttgaccgacatttagccattctgcccagcgttgtaccgcttgttcatctgggctgctctcatcgttcgtaacagcaatcgcctctatcggtaaagagcggaacatggtttctttatagagtgggtctgcaaagttgttgccgctaaataagccaaactgatagtcatttttcttcatcacatcaatcagtagcggcgcattgccttgcactcgcacactgctggcgtaggtactcggtaagccgtaaaacagaccaaataagccaaacatatcgttacttgaactgtaatgattggtgaaattgagattctcattcgcaaactgataagtattgggcatgagttcaggggtcagggcatctgcacgcaaattattgatgctgactatcagcacgttcaaattattggctctacgactgaactctaacggttcgagtgggtaaatcagaccgtcaatatcactattctgttcggcaaggcgcttgctgtactcttctttatcgagcaagccgtgcttttccataaaggattttgccgtcattggataagagagcgggaaattcgctcgctgactggtgaccggggaatagagatatgcatccgaccacacataaatcagatggctggcgatgaaactgaagaaaaagacggccgctagaggtcgcccgatgcgtttgtgtgacagtttacgctgcttgcgccaaacccattctgataaaccgagctcaaggagaaagatgaggggcagtaccacaaacaaatgctgcaaatccgcactgacactgctggtttcatcgctgaatagcagttcccacaccacagggttgaggtgcagattaataatttggtaggcctgagtatcaatcagtaaaacagtgaggcctaacgtcgagaagcatacggccaaaaagcggaataagcttctcgatggaataatgaaagtaagtggaaaaagcactaacaggtagagtgcgaaaaccaaaaagccgaaatgtccaacccaagacagcgcaaggtagagctgcccaagcaaggtttctggccaaggtgattgagagatatatcgtgtgccaatcaacatggcagcgatgatattaaagaaggcaaaccagtgcccccaacctactaaacgagatacccgatcgccgtatgtatttccgctatctaccatgtgctttttctatttatgggttaaatggggcaatttagctttgcaaagacgacactaatgcttgcgcgaatttttcagcaatcactttacgttgtgcagcagcaacattttgattgatgacattcgttgcgatgttgccaaccaccattaaggtgagctctggcgaagcattatgtttatttagtaccgcagcaatttcagtcagaatggattcaacgtgttcgtcactgtatttagatgtaataggcatattgactctgatgatgatagtaaaagcggcttatgataacctactatgcctgacaactgaaaccagaacgatgattatttcactatgagcctattcctttctaacgtgattttgcaccaactccgtaaaaatgataacgatgaattggtggtgaattatcgcgccgaatctcttcgcaatgatacgtcaactgaaaacttagtcgctgagttacatcgtgtttttaatgcaaaagccgggaaaggtttcggttgctttaagtcagacagtgaattccagctttggttgcaagagatgcgtcgtggaaccctgccattctatgagttttcacagcaaagcgctcaacgcctaaaaaatgagttagccaagtatccttttgctgatgaagggatcttagtgatggccgaatatcaatctttggcgacggattatctctttattggtctactgcctctcaatcaaagtttgaaagtgacagaagggctcgacatcagcgctaccgactatctagacatcaacaaaatggatatcgtggcgcgtattgatctttcgagctatgaaaccgacaaagagtccaaacgttacctgagttacatcaaaggtcgtgttggtcgtaaagtggcagacttctttttggactttctacaggcggatattggcttagacaccaaacagcaaaaccaagtgttgatgcaggcggtggaagacttctgtgctgacgcgaaattcgaaaaagaggaagtgatcagttacaaaaagcaggtgtatgagtactgtaacgatcaaatcaaagcgggtgatgaagtcagagtgcaagagctctccggcgagctgcctccgagtaatgagggcgtcaacttcttcgatttcactcgtgaacaaggctatcagttagaagagagttttcctgccgatcgttcaacggttcgtaagctaaccaaatacgtaggtgcgggtggcggtttaaacttgagttttgatagtttgttgctcggcgagcgagtgttttacgatccagaaaccgatacgctgacgattaaaggcactccacctaatttgcgtgatcagttaactcgcctacgttaaacatcagcccgacgatcatgagataagtaggtaggtttcattgagttcattgaaaaagagagcgatcacgctctcttttttgtacgcaatttattgcgtgcaccatcaagagtcaaaatagggtatatgcttgatctgaagttctaaacaggatggttaggcatggcacagaccttattgaatcaaggtgttaggaagaaagtcgtgatggctattttcgcggcttggagtttggtcgccgctttggtgttgtggcaattctccttgatctcttcctcctcacgcagtctcgatgaactcaccaatcgtttgatgcattttcgtgagacgctctattttgcgcagccctatcgagccaatcaagctcctaatttggagcttgagctgtcattagtcttagctttacgcatgcagattgaagctgaacagtcgaggatatggattcggcgagatgtgcagcagctcttgtaccaaaccgatcgatttgttgaacaagcgcgggcgtttttaaccattgagctgcatccaacggagttggctgagcgctttcgtgaaagtcgtcagcgtgtgcatgccgatcctcagttattgtcagcgtatttccagttaggcgcgtttagctttgaagcgttgtttgcggataatagaaacagtcctgaaatctatcgaagtttagatcgtattttgcaagattctttatccttgcccagtcgtgaacaagaatcgctgcaagttgctttggcacaagtttctcgcttactgacgcaatacgccgaaggcgataacctcgtcggaaaattgctcaatcatgctgtctatgaagaggcgagtatgcttgaagaggagtatcaccatcagctctggatcatgatggtgattctggttggggctagctcgatagcgatgctctgttttatcgtattgccatcccgtccccagtttttgcctcgatctgcttcaaaccaagaaaatacaaaatttcacaagctaggtggcatgagtcatcaagtcaatatcgcgctggtagagcaaacgctgaatggcgactttgaagccgttcggcagctactcaaagtttttttggaagatcataaaaatgatgatgagcagatccgttcgctgttactcagtaatcctgaagccgcgcagcgacattgtcatagcctaaaaagtgttgcggcaagccttggtgctgagcgattaaagcaggtcgctgctgaaatagagagtcatttacgagcggggcagctcccaagtgaaagagccttggataatctttctgcttatctggctgaaactgtgcgtgaggcagagtggcatgtatcgcgattgccttcggatgaattatcaataaaaagagcgccttagcgctctttaaaagataacaagtgatggaacgttgttatgcagaagccggtgctttctggatttcctctgccgtcacttcttgttcattcatggcctgtgtgggttcacatttatcgacaaaccaaccacagtaagatgtgatgatagtgacgagaatacacacgaagcttagccacataaacggtgcataagagagagtcgccacacccaaaatgctcgccatatagatgccgttatcactccaaggcaccatgccagaggtcagtgtaccgccgaattctgcgttacgagacaagttcttacgttgatagcctaaacgatcgtagttcttggcacagatttttggggtcaggatcagtgatacatacatcgcagaaccaaaaacgttccccataaaggcggtaccgatagtgctggtcgctagcgaacctgggctagtgactcggcgctcgaacagtttggcgatggtttctagcacgccgactctatcgagcagaccaccaaaaccaagaccgaagacgataaccgcaaccgatccgagcatggatgacataccgccacggttaagaattgcatcaataaagcttacgccagattcaatattgtaaggtgcccatgcggtgttgaacgcttgaaggaaatcgacatcttggatcatcacagcccaaacgataccgagcaatgaaccaaagctgatcactgggaaagaaggcatacgcattgccaacaaaccaagcacaatcaacacaggcacgaaagaataaggcgtgatgtagaactgctgttccatcgcggcaatgaccgtctctacttgtgacatatcgacgttgccagcgtaatggaaaccaaacagagtaaacagaatgccagtgatcacatagctgatcagagcaatcggtaacatgcctttaatgtgttccatcacttcaacgttagacatcgaagaggctaagatcacagagtcagacaggggagacatcttatcgccgaagtaacagcctgacagcacagcaccagcagtgataggcgctggaataccaaggccttgtccaatccccatcatggcaataccggcagtacctgccgcaccccaagaggttcccgttgccagagcagtcaatgaacaaatcaccatagtggctaataaaaagatagaagggtgaattgcttttagaccgtaatagatgatggttggcacaataccgccggaaatccacgttccgacaagagcaccgaccgccaataagatcagcactgcgcctaaaccatttgaaatgccattcagggcagcattttctaagtctttgtatttatgtcctaggcgaatacctaacgtcatgatcacgaaccagccaatatacagagccagttggatcggtaaatccagttttgcggtaaatgaaaacgctaacagcaaaaataggccaagcgagacgattacttgagtcaaacttggcaggcgttgttgggcttgtaacatactaagagcctcttatccaatcgttagtaaggagtcaggatatccttattgagtcgaggtgcactttaccgtagttaaaataatatatcgacattaaagctctttgttgtgatttatatcgttcaagtggttaatttgtagcatttgctgtttattttttgagtaataaatgaaagcaaatcttttgtgaggtgagttttttgtgttacaagaaataagttttttggtaaaaatctgacgtcaatactctaacttggttaaaaagtgagagttttaagatgcttgccgtaaaaaagcgaataaccccgagagaaggataagaaaaagttgtcagatttgctaagaaaggcttgagatttcaggctgaaccacttatagatggagccagtgatttgacattggatctacacggagagtaagggaaatgagagtaggtttagtaggttggcgtggcatggtcggttctgtcctcatgcaacgcatggtagaagagcgcgattttgatctgattgaaccggttttcttcagtacatcgcaaattggtgttcctgcccctaattttggtaaagatgcaggcatgttgcacgatgcgttcgacattgagagcctcaagcagcttgatgctgtcattacctgccaaggcggtagttataccgaaaaggtctacccagcactgcgtcaagcgggttggaaaggttactggatcgatgctgcatcgacattgcgtatggataaagaggcgatcatcactctggatcccgttaaccttaaacaaattctgcatggtattcatcatggtacaaaaacctttgtcggtggtaactgtactgtgagcttgatgttaatggcacttggtggcctgtatgagcgtggcttggtggaatggatgagcgctatgacttaccaagcagcatccggagcgggcgcacaaaatatgcgtgagctgatttcacaaatgggtgtgattaatgatgccgtcagctcagagcttgccaatcctgccagctccattttggatattgataagaaagtggctgaaaccatgcgttcgggttctttcccaaccgataactttggggttccgctggcaggttcactgatcccttggattgacgtgaaacgcgataatggccaaagcaaagaagagtggaaagcgggtgtagaagccaacaaaattctgggtttgcaagattctccagtaccgattgatggtacgtgtgtgcgtatcggcgcaatgcgttgccactctcaggcattgaccatcaaactgaagcagaacattcctctcgatgaaatcgaggagatgattgctactcataacgattgggtcaaagtgatcccgaatgagcgtgacattaccgcacgtgaactgacacccgctaaagtaaccggcacgctgtctgtccccgtcggccgcttacgcaaaatggcgatgggcgatgatttcctcaatgccttcacggttggcgaccagctcttgtggggggctgctgagccgttgcgccgtacgctgcgcatcattttggccgagaaataatcgtctcccttggcgaagccacatctcctaacaaaaaagcgccgtttggcgctttttttatcgacgtcttaaatcgagttattcacgatttacgctaagccgggaaacaagttacgtagcccattggcaataaattcaataccgagcgcaccaaggatcagacccatgatacgggtgattacgttgataccggtttgtccgagcaagcggacgatatacggtgctgaacggaaaagcagccaagagcaaaaactgaaggcgacaacggtcaaaatgatccccaaggtatccagcatatttggataacgtgagccataaacaatcgttgaactgatggctccggggccggccatgagtggcatcgccagtgggacaaccgcaatttgctcacggctgatgtattcggatttttcctgtttattctgcttatcctcaccgagcttaccgctcatcatcgaaaaggcgatgctaagcagcagtaaaccgcctgcaacacggaatgaatcgagagaaatactgaagaggtcgagcagcatttgacccgccagtaaggcgatgatcaagatgatggccacggcgatattcgcggtcgctgcggttttatttttctcttccagcgtcatgtggccagtaagagaaacaaataccggcataatgcctacagggtttactgcagcgacaaggccgagaaaaaattggaggaatatagcaatttcaaagctttgcatgatgaagtctcgtaaccatcattgggacgtaaagaagcgtgcgtaatgtaagttaaagatagcaaaagcacgaatgaaaaaaattgagtcgctattgattattatgtgagaaaaactaattgatgaagaattatgcaaagagtaagtgtcattcttgtgtcaagtttgtttgctcataatgtcgcctgttaacattcgcacattttttgtaaaaacttaggcaatggctggtggtcgtaagcataaccgatatactctcagtagcacgttaaccccctcttaaaagtggtggttgtgtttaaaaatgaaacttttttacaggctgttgtagtttttttagtttttgaaagctaagtgcggtttttttaatcacgagtggttttttgtttaaatcgtttaatttcaattgtttaatttatgtttttactcttgggtaccacttgttaggtaattagtttttcataactgatctgagtcaatttttttcacagtctgaaatattatactcagtcgtgaaagcaatttactaagtcggttgtaagttaagtctttgaaccacagtaaaaacgaactgcagcacacttactaaagagtttttaacatttttttattttaggagattcattatgcctgttactaatctggctgaacttgatgctctggttgctcgcgttaaagcagctcaagctgaatttgctactttctctcaagaacaagtagacaaaatcttccgcgcagcctctctagcagcaaaccaagcacgtatcccgttagcacaaatggcggtagaagaatcaggtatgggtattgttgaagataaagtaatcaaaaaccactttgcttctgagtttatctacaacaagtacaaggacgaaaaaacctgtggcatcctcgaagaagatgacaacctaggtactatgactatcgctgagcctgttggcatcatctgtggtatcgtcccaacgactaacccaacctcaaccgcgatcttcaaatcactgatttctctgaagactcgtaacggtatcatcttctctccacacccacgtgcgaaaaactcaaccaacgcagcagcgaaactggttctggatgccgcaatcgcagcgggtgcaccaaaagacatcatcggttggattgaccaaccttcagttgagctgtcaaatgctctgatgaaacacgatggtatcgcactgatccttgcgacgggtggtcctgggatggtgaaagcggcttactcttctggtaaaccagccatcggtgtaggtgcaggtaacgttccagttgttatcgatgaaactgcagatatcaaacgtgcggttgcttctatcctgatgtctaaaacgttcgacaacggtgtagtgtgtgcttctgagcaagcggctatcgtagtgagcgaagtttacgacgaagtgaaagagcgtttcgcaacgcacaaagcgcacgtcctgagcaaagcggatgcagacaaagtgcgtaaagtgctgctgattgatggcgctctgaacgcgaagatcgtaggtcaacctgctgctgctatcgctgaaatggcaggcgtaaaagtacctgcagatactaaagtgctggtgggtgaaggtctgggcaaagtctcttatgacgatgaattcgctcacgagaaactgtctccaacacttggcctgttccgtgctgacaacttcgaagacgcggttgctcaagcggtgactatggttgagatcggcggtatcggtcacacctcaggtctgtacaccaaccaagacgttaacgcagaccgtatccgttactttggtgataaactgaaaactgcccgtattcttgtcaacatcccgaccactcacggtggtatcggtgatctgtacaacttcaacgttgcaccgtctctgactctgggttgtggttcttggggtggtaactcaatctctgagaacgtaggtcctaagcacctaatcaacaagaaaactgttgcgaagcgagctgaaaacatgttgtggcacaaactacctaagtctatctacttccgccgtggtagccttccaatcgccctgagcgacctagaaggtaaaaaacgcgcattcctagttactgaccgtttcctattcaacaacggttatgcagacgatgtggttgccctgctgaaagcacaaggcatggaagttcagacattcttcgaagtagaagcggatccaacactgtctgtcgtagaaaaaggcgctgcagcaatgcaaagcttccaaccagatgtgattcttgcgctaggtggtggttcaccaatggatgcggcgaagatcatgtgggtaatgtacgagcacccagatactcactttgaagaactggctatgcgctttatggacatccgtaagcgtatctacaagttccctaaaatgggtaaaaaagcagagcttgtttgtatcactaccacttcaggtacggggtcagaagttacaccattcgcggttgtgactgacgacaagactggcgctaagtacccactggcagactacgaactgacaccacaaatggcgatcgtagatgcgaaccttgtgatgaacatgcctaagtctctgaccgctttcggtggttacgatgcggtaactcacgcactcgaagcttatgtatccgttcttgcgaacgaatactcagacggtcaagcactacaagcgctgaagatgctgaaagagtacctaccttctagctacgcgaatggtgcgaaagatccaatcgctcgtgagaaagtacacaacgcagccactatcgctggtatcgcattcgcgaacgcgttcttgggtgtatgtcactcaatggcgcacaaaatcggtgctgagttccacctaccacacggtttggcgaacgctctgctgattgctaacgtagtacgttacaacgcgaacgacaacccaaccaaacaaacggcattctctcaatacgaccgtccacaagcacgtcgtcgttacgcagaagtggcggaccacttaggtctgagccaaccgggtgaccgtactgcacagaagattgagcgtctgctgacttggttggatgaactgaaagttaacctagacattccaaaatcaatccaagctgcaggtgtagcagaagcagacttccttgcaaaagtggatgagctagcggttgaagcgtttgatgaccaatgtactggtgcaaacccacgctacccactgatcgctgagctgaaagaagttctgctggcttcttactacggtaagccattcgttgaaggtcaaactttcgaaggcaccactgttatcgtaaagaaagcagatcaagaagcggcgaaagcgccaaaagcgaaaaagtaatgtgattggttttcgctagcacgaaacaaatcgggaaattcaaaccctccataaggagggtttttttatgccatgactttgggaagagtcagtaagatggccacttgagttaggtccacatcaccaagatagcggccagagccactaagataagcccgaatccatctttaattcgcactttttgacctagccagaagatggagatcaacatagtgaaaaagatctccacttggccaagcgttttcacataaggcacggcttgcagtgacatggcgctaaaccaacctatcgagcctaagcaactgctcacactggtcagcatgactaacttcgggcgttgccaaagcttgtacaaggtcgatctctctttaatgagcaagtatccgaccaaacagagtgtttgcagcgagatgaccaacaacaatacccaagctgcgctgtaagggaaggggagttgtgaggcgagactggcttcacgaacccagagtgaagtgagagcaaatgcactaccgctgctcaagccaagaagtacggtcgggagtgaaagctgtttaaaaccgccgtgactgctcagcataaagactccaaccccgccaatcactacaccaagccagcctaataccgtgagttgagtgccgaaaaacagcatacccaagattgcagccaccaaagcttcgcttttagccagcccagcaccaaccgcgtagttgttgtatttaaaaagcttgaccattaacgcggtagccaggatctgcatgaacgatgcgccgaccacataatgccaaaatgcactggagaaggtgggtaatgcggcaggttgccattgatagagtgcgatcagatacacgccagcaatcgggcttgcccagagaaagcgtgcgagggtcacacctgctgttgtcacatcgccagataaacggctctggaatgcgttgcgccatgcttgcataaaggcagcaaacagggtgagaaaaatccatgtcatggtgtgctccggaagaaagtggaagcaccatgctagagaaaggctaaattatcagcaagttaaatcatcgatggctggccgtcgtgaacaaggcagcgcgaggctgccttggtgatattatcccgccaaaacatcactagcgactttgtaggttggatcttctttaaggttgatttccactaagctgcctactttctgtagtagagcgcgacagtcttggcttaaatggcgcaagtgcaaggttttaccaacggcggcataacgttccgctaaggtttctatcgcatcaatcgctgaatgatcggccacgcgcgagcgagcgaaatcgacaatcacttctttaggatcatggtgcgcatcaaacaattcaaggaagttcgcggccgacccaaagaaaatggggccatgaatatgatattccttatgcccatcaggattgatatggctggctgcgtaaatatgcttggcgtgctcccatgcaaacatcaacgcagaggcaatcacaccgactgcgaccgcaatcgctaaatcggtaaacacggtgaccactgtcaccaacacaatgacgaagaaatcttgtttcggaactcggcgcgctaatttgaaggtagcccattcaaaagtgccaatcaccaccataaacatgacgccgactaatgccgcaagcgggatcatctcaatcaaagaagcggtaaacaggataaagcacagcagcaatacggctgcgactatccccgatagacgaccacgtccaccagagttaacgttgatcatcgattgcccaatcatggcgcagccacccatggcaccaaacatggagcacgtgatattggctaagccttgccccatacattcacggttggattggccgcgagtgccagtcatttcatctaaaaccgtcagcgtcagcagtgactctatcaagccaatcgcagcgagaattaaagcataagggaaaatgatctttagggtttcccaagtcagaggtaccgcgggaatcgaaaaagagggaagagagcccgcaagagttgccgcatcattccccgacatagcccgcagaaaatccacgacggtacgagtttccaagcctaaaccttgaaccagcagagtgacagtgactatcgccgccaatgaagaaggtatcgcggtggtgagtttgggtaggaaatggatgatcgccatcgttaaggcaaccagccctaacatgaggagcaattccttttgtggtagccaagtcatgactccgttgagatcgggagctttaaattggccgagttgagctagaaaaatcacaatcgctagcccattcacaaaaccaatcatcactggatgcggtaccatgcgaataaatttgcctaacttaaacaagcctgctgcgacttgcagtaaacccgtgagaagaatcgcggcaaataaatactgcacaccatggcttgcgactaagctcaccatcactactgccattgctccggttgcaccagaaatcataccgggccgaccgccaaaaatggaggtaatcaggccgacaataaacgcggcataaaggccaaccataggatcgacccccgcgacaaatgcaaaagccaccgcttctggtaccagagccagtgcgaccgtcaacccagataacacatcattttttattgagtgctgcgagaaagaagggaattcaaacatgggcaaaaccgtgttccgtatttgtgctgctcatgaatgatgagcatgaagtgaaccgagccgcttaacataaagtgaaagatcaaggtgtgactaagcgggttaattttgaactgcggatgctacagaattgaacggtagggtgcaatcatcaattacagtgttagcccatatcaccagcatgaataaggtcatccccttgctacttgagctttagcgctattggctgcaacgccaagtagtatgtacacaaggcatctaggcaagagatgatgcaaggctgttgggaaatttaagaatcacgggtaaaagaaagggctgcgttggcagcccttatcgtatggtttcgctatttagaagctttgcggcttgctcatgcccgcactggcttgattacgcgcgacttgactacccgcaccacgcgcttggtaacgttcagcacgtaaaggcgcggcgttaacctgcacttcacggatgtcatctgagccaggtgctttagtcatcggcgatgaggcgtacggctgttggatgaccgctttcgcggtgagtgatgttgcactcactgtcactggcttaacaaccttaattggttctgccattttgtctgcgatcacttcaaccgtcgtttgtgcgacaacctcgtcactgattgtggctggctcttcgacttcagcgactttcgccactacggtttctagcgcagcagtttctgttgctgactcttcaattaccggagcttcaatcactgtagcttcaaccacgaccggctcaacgggtgcgatgagtgtctctgcgatcacgtcagtaatcactggctcttgcactactggctcaggttgaaccgcagcagtttcacgacgtacgatgactttacccatcgccatttctgggaaggcaacgcctccgagtacacgtggcgctgccactttttcgctttctactactgcagttgccgcagtcggtgttacatgagtcacatgttgagcaccttcagcagtttcatggcgtgactgtggacgcggcgctaagtcgtagcgaggcatcactttacccatggccatctcaggagaggcaaccccacctttacgcaggcggaatgggttagggcgacgatcacgaccacgacggcggcgctggccgctggcgcgcagatgacgtggcgagcggcgattacgacgctgcttctgatcatcttgctcgttatcctcttgagccgaatccgcaaaatcatcggttacaggcagattaactggcgctggagcgtcgaacgcattgtcaacaggagctgtagacaggttgtctaactcttctgcggcaagctgatctttgactcgaatttgcttcgagagcttacgacgttgacgacgttctttaacaaccgcggctttctcttctttaggctcaacggctttaacttcttgttgtgcttcagccgctaattggcgaccttgctcaagcaatttagccgttttactttcatctcgtttattacgacgatcttgacgttctggacgctcggtttctggacgttcattgcggtcattacgttcgttacgctcaccacgctcttgctttggcttgcgctcttgtggcttacggttgctgtttgatgtctctttatcgttacgctcgttgttttcctcattaccgcggcgacggtttttgtcacgagggttacgacgacgatcattattacgatcgttacgttcacgacgaggtttgtcttgttcactattctgcgttacaggcgcttctactttggccgcttccggtgtcgcagagaataggctcgcaatcgctttaaacacacggctaaagaaaccaggctgcgcaggttgctgtacctctgcaacaggttgaggttctgctttaggttttggtgttggagcaggaaccgcttccgcaggcgctgcaaaacctttcagtactggctcttcaatacgttttggtttgagctcaacatcgaccacttctttgccttccgcttctttcatcgcttccagctttttcggaatcaggtaagagagaacatcttgctcttcaccttcacgcacgcggatcacttcaaagtgcggtgtttccatatcggaatttggcacgatagtaatgcgaacttgctgcgctttttcaatgtgattgattgagcgacgcttctcgtttaacagataagacgcgatagagacaggtaccaccgcaagcacttgcgatgtgttgtctttgagtgcttcttcttcaattaagcgcagaacagaaagtgccaaagattcgttgtcacgaatcacgccggttcctttacaacgaggacagatgtgatggcttgcttctgccagagaagggctcaaacgttgacgcgacatctccagcaaaccaaagcgagaaatacggccaatttgaacgcgagcacggtcaacacgcaccgcttcacgtagacggttttccacttcacgctggtggcgaacaggggtcatatcgatgaagtcgatcaccacaagaccaccgaggtcacgcagacgcaattggcgtgcgatttcatctgcagcttctaggttggtattgagagcggtctcttcaatatcgccacctttggttgcgcgagcagagttgatgtcgatggaagtcaaggcttcggttgggtcaataacgattgaaccaccagaaggcaggcgaacttcacgttggaaagccgattcaatctggctttcgatttggaaatggctgaacagcggtacttcgccttcgtattttttcacacgattgacgaaatctgggcgcactaaacggatatgctcaagagcacgctcgtaaatgctgttgctgtcgataagaatttcaccaatatcacgacgcaagtaatcacggatcgcacgaacaatcacgttactttcttggtggataaggaaaggtgcagggtttgaatcagacgcttgtttaatcgcactccagtgcttaagcagtacatttaagtcccactctagctcttcagcgcttttacctacgcctgcggtacgaacaattaagcccataccttgtggcaattctagtgagctgagtgctgatttcagttcagtgcgctcatcgccttcgatacgacgagaaataccgccagcacgagggttatttggcatcagaactaagtagctgcccgctagagagataaaggtggttagggctgcacctttgctaccgcgctcctctttctcgatttgcacgatcacttcctgaccttcgttcagcacatctttgatgtttggacgaccttggtagctataaccatcagggaagtattcacgagcgatttctttgagagggaggaaaccgtgtctttcagcaccgtagtcaacgaatgcagcttcaagactgggttcaatgcgggtaatgcggcctttgtagatatttgcttttttcgattcgtgccccggactttcaatatccagatcgaacagacgttggccatcgaccaacgcgacacgcaactcttctttttgagttgcgttaattaacattcttttcatttaaaaatctcattttcttatatagttttgattcttgtttttgttgccgagtttcgttttcacggtgccagatcccatggcttattcgatacagcctcccggctggaggggatgctctggggcacatcagtattcacaagccaacgattgcctgtgatccgctataaaggcggtgggtactcaacatgaaaaggcgacgagtagagcaacaaaaagcctcaaacagtgtgtcttacgccgtgtgctgcaccttgttttcgactgactactcattaatttgccagaaattgaacggtaaagaacaaaatgccaccggttcagctcttgcagctgtgaactatagcagtgactgccaaagtcagcaatcagctttccaatgtagcgcaaattatttgcgggagattacaaaaaaccaacaatctaacttattgttaaataaagataagatgattgaaatgttaggcttggagcatccgtgcgaccaaattaggtagtgagcccaaggttaacttggttaaattgtcggcaaatggggttgatgctaatgaaaaatggctttttttgttgctaagaaaatgtgactttaactcgattccagatagaatagcgccatgaacgaaatcagaactcaagtccagttcatcgacattgatgaagacatggctggtcagcgcattgataattttttgcgcaaccaattaaaaaatattcccaaaagcgtggtttatcgaattctacgtaagggagaagtgcgcgtgaacaaaaaacgcgtaaaagcagaatacaagctcgaagcgggcgatgtggtgcgtgtgcctcccgtcaccgtggaagtcaaagagaacgagcctgctccaccgagtaccaaactcagtaaagtggcggaattagaacactgtattgtctatgaagacgatcatttactcatcctcaataaaccgtcaggtacggcagtgcatggtgggagcggtttacactttggtgccattgaagccttgcgcgccctgcgcccccaagcgcgttttcttgagttagtacaccgtattgaccgtgatacctcagggattttgctggtggccaaaaaacgctcggcactgcgccacttacaagctcagtttcgcgagaaaacggtgcagaagtactactacgctttagtcatgggacattgggatgcagagtgtaaagtggtcaatgcgccgttgctgaaaaatgaagtcaacagcatagtgcgcgtgaaccccaacggtaagccgtcggaaacccgattccgtattcttgagaagtttgctgaagcgacgttagttcaagcgagccctgtgactgggcgtacgcaccaaattcgtgtacacactcagtacatggggcatccaatcgcgtgggatgatcgttatggtgatcgccgctttgatgcttatacagcgcaatttgggattgagcgcctgtttttgcatgcggcaaacatccaatttgtgcatcctgccagcgagaaaaagttggaaatccatgcgccactcgaagcgcatttggagcaagctctgacaaaaatgcgtcaggcttaaaccggatgcctaaacaagaaaagggcgataattcgcccttttctgttagtttttcgtgataaagccttgcggtgtccgttgtgcaatgtcaacgctaaagtcaaatcacattgagcccttcattttctaacaactgaatgagcttaatcaggggtaagccgatgagcgaattggggtcgtcgccttccaagcgctcaaacaaggcaatgcctaatccctcacttttaaagctacctgcacagtgcagtggttgctcagcctcgacataacgtctagccatactctcggataaggttcgaaaatgtaccgtaaaggtatcgcaaagcacctgtgtttgctgagtttggttgttaaaaagcgctaagccagtataaaaggtaatcgcttgaccactttggcgtaaaagttgttcaacggctttttcagtagttaagggtttaccgatgatttggtcatcgatcacgcagacttgatctgacccaatcactaagctcgggtctgctaaaaagcagctacgcgctttgttttcagccaagcgcatcactaagtgttcgggtgtttctccgattaacggcgtttcgtcgcaatcaggttttgcagtgacgaaaggcagctttaatttcgccagaatttgttggcgaaatggagaggtagaagctaaaactagttggtaattttgcattttactttacaatcatcgcgtgtttgacagcagcataacgtatcctaatgcgctgttcataatgctctctgtggaaagggaaaaaaaaccaagttttttgcctttttctttgactaaatctgttttggaagataatattcgcgccctatgcaaaaggtaaaaataccgcgaacggttgatccggctaaagccgctcagaaaagattagactttgatggcatcatccaagttaatttgttcaagcgcttagaggagtcagtcgcaggcgttaaacgcgacgctgaagtttcattgtcatttgagattgatgaacagcaactggttgttatctctggtaaagctaacatcgaagttgatttagagtgtcagcgctgtaacgaggttttcgcacacgagtgtgaagttgaatttacttataccccttacttaggtcgtaaaagtgaagaagacgccccagacgagtatgatttggtagatctaaacgagtttggtgaggttgacctagttcagttagttgaagacgagttcatcttgaatttgcctcaagttgcgatgcatgacgaagcggattgtagcgttgattcagacaatttggtgtttggtgaacttccagaagaagttttggaagagaagccgaatccattcgatgttttaaaaagcttgaagaagtaattcgctaagcattcttaacataggagtagggtccatggccgtacaacaaaaccgtaaaacacgttcaagacgtggcatgcgtcgttcacacgatgcgctaactgctgcagcgctatctgtagacgcaacttcaggtgaaactcacctgcgccacaacgtaaccgctgaaggttactaccgtggtaaaaaggttatcaacaagtaaggttgacctttgcaaaatttaaccgttgcacttgatgcaatgggcggggatttcggtccacgcgtaacagtgcctgccgccgtgcaggcactgtcacatttcccagagctaaaagtgatcttagtgggtgatcaacatcagatcactcaacaactctctcttcttggttattcggccgatacgcgtttaagtattgtgcacagtgaccgtgtcatctccaactccgaaaaaccttcgcttgctttacgtcatagtgctggcagttctatgggcatggcgattgatcttgttgctgaaaatcaagcggatgcgtgtgtcagtggcggaaataccggcgctttgatggcgctgtcgcgttttcgtctcaaattgctaccgggtattgatcgtccggcgctggtttctgctctgcccactatttctggccgcaaaacctggatgctcgatctgggcgcgaatgtctcaagtgatgccgattctctgtttcaatttgcggtgatgggcgccgcgcttgctgagcagcatctgcagcaagctccacgagtggcaattttaaacatcggtgcagaagagattaaaggcaatgatctggttaagcgctgtgcggaaatgctgacccaaactcaggcgatcaatttcattggttatattgagggtaatcaactgttaactgatgcggcagatgtgatagtgtgcgatggctttgtcgggaatgtctgccttaaagcgtgtgaaggaacagcgcaactctttatcgataagttaaaaaaatcgcttttagcctcatccataaagggttggattgcaagaaaactgttttctgagctctttactgaattaaaaaccctgaaccccgaccagtataacggcgcaagtttgctaggattgcgcggcattgtcattaagagccatggaagtgctgatgtatccgcggtcgtgaatgcgatttctgaagcggtgcatgaggtgaaacgacaagtacccagccgtataagcgatcgtttggaagcggttttactcgagaggcattattagtcttcatgtatagcaaaattttaggtactggcagctacttgccatctcaggtgcgtactaacgcagacttagagaaaatggtagagaccagtgatgagtggattgttgctcgtactggtattcgcgagcgtcgtattgcggctgacaatgaaaccgttgccgatatggcattcttcgctgcacaaaatgccataaacatggccggtattgataaacacgacatcgatatgattattgtggcgaccaccagtgcgagccacactttcccatcagccgcttgccaagtgcaaggcaaactgggaattaaaggatgtccagcgtttgatttggccgcagcgtgttctggttttatgtacgcgctctctattgctgatcagcatgtcaaatctggcatgtgcaaacatgttttggtgattggtgcggatgcgttgtccaaaacctgtgaccccacagatcgttcgaccattatcttatttggggatggtgctggcgcggtagtggtgggcgcaagtaacgagccgggcattctttctactcacatccacgcggatggcgagtttggtgatttactgagccttgaagtgcctgttcgtggtggtgatagcgataaatggctgcacatggcggggaacgaagtgttcaaagtcgcagtaactcaactatctaaactggtagttgatacgctgaaagccaacaacatgcacaagtctgagctcgattggttggtaccacatcaagcgaactaccggattatctcagcaaccgcgaaaaaactttcgatgtcgctcgatcaggtggtgattaccttagaccgtcatggcaacacctctgcggcgactgtgcctacagcgttggatgaagccgtgcgtgatggtcgtattcagcgtgggcagatgctactgctcgaagcttttggtggtggtttcacatggggctctgctctggtgaagttctaaacgcacaatgaattttgactttaaggagtcctaggactccttatccattcttagatgaaggaaagatttatgagtaagtttgctatcgtatttccaggtcagggctcgcaagcagtaggtatgctggctgaccttgccgagcagtatgctgtggtaaaacaaacattcgccgaagcttcagaagtgcttggttacgatctgtgggcgctggttcaagatggccctgtggaagatctcaaccaaactttccgtactcaacctgcgttgcttgccgcctctgttgcgatttggcgtgtatggcagcaactgggtcttgagcaacctgcggttttagctggtcacagcttgggtgaatattcagcactggtatgtgcgggcgtgattgattttaaacaagcgatcaagctggttgagctgcgtggtcaattgatgcaacaagcggtgcctgccggtacgggtgcaatgtacgcgatcatcggtctagaagatgaagcgattgctaaagcctgtgctgacgcggcgcaaggtgaagtggtttctcctgtaaactttaactcaccaggccaagtggttattgctggtcaaaaagatgcggttgagcgtgcgggcgttctgtgtaaagaagcgggcgcgaaacgtgcgctgcctctgccagtttccgtaccatcacactgcgcgttgatgaagcctgctgccgatgaattggcaaaaactctagcagagcttgaattcaatgcaccacaaattccggtcatcaataacgttgatgttgtggctgaaacggatccggtaaaaattaaagatgcgttgattcgtcaactctatagcccagttcgttggactgaatgcgttgaacaaatgagcgcacaaggtgtcgaaaagctgattgaaatggggccgggtaaagtattgactggtctaacaaaacgtattgtaaaaaccctagaaggtgtcgcagtcaatgacgtggcttctttggatgcggtgaaataacaacaggaagaaaacatgagtcaattcatgaatctagagggcaaagttgctcttgtgactggcgcaagccgcggcattggtaaagcgattgctgaactcttagctgaacgtggtgccaaagtgattggtacggcaaccagcgaaagcggtgcgcaggcgatcagcgattacttgggtgacaacggcaaaggtatggcattgaatgtgaccaatcctgagtcgattgaagcggttctgaaagccattaccgacgagttcggcggcgtcgacattctggtgaacaatgctggtatcactcgcgataatctgctgatgcgcatgaaagaagaagagtggtcagacattatggagaccaatctgacgtcgattttccgtctgtctaaagccgttttgcgtggcatgatgaaaaaacgtcaaggtcgtatcatcaatgttggctctgttgttggcactatgggtaacgcaggtcaagccaactacgcggcagcaaaagcgggcgtaattggctttactaagtcaatggcgcgtgaagttgcatcgcgcggtgtgaccgtcaacacagttgcaccaggttttatcgaaactgatatgacaaaagcgctgaatgacgagcaacgtactgctacactagcgcaggttccagcaggtcgactgggggatcctcgtgaaattgcgtctgcggttgctttccttgcatcaccagaagcggcatacatcaccggcgagacactgcatgtcaacggcggtatgtacatgatctaacaattttgccttattgagcgattgagcaaattcagcgctcgtgaggcaaatttgtgtgaaaaatgtaagtaacatgcacaatatttatgcatgatttatatcaaaaatggtgtgaatttcggttaaaatcgcctaatttgtggttagaccagaaacctcacgcttgcaactttccctagttcgaataaactacggaatcatcgcattaggcgaaatctgtaaaggaaaagaaaaaatgagcaacatcgaagaacgcgtaaagaaaatcattgttgaacagctaggtgtagacgaagcagaagtaaagaatgaatcttctttcgttgaagacctgggtgctgattctctggacactgttgagctggtaatggctctggaagaggaattcgatactgagattcctgatgaagaagcagagaagatcactactgttcaagctgcgatcgattacgtaaccagcaacgctcagtaatctctcctcaggcggctcactggccgcctgaatttttcttagttctcaaccctctctcatttcaatttcaattccggagaatattatcgtgtccaagcgtcgcgttgttgtcactggcatgggtatgttgtcaccggtaggcaacactgtagagtcatcttggaaagccttgttggccggccaaagcggcatcgtcaacattgagcacttcgacactaccaatttttctactcgtttcgcaggcctggtaaaaggttttgactgcgaacagtacatgtcaaaaaaagatgctcgcaaaatggatttgtttatccagtatggtatcgctgcgggcattcaggctttggaagattcaggcctagaagttaatgaagaaaatgctgcgcgtattggcgttgcgattggttcgggtatcggcggccttgagctgattgaaaccggacatcaagctttaatcgagaaaggcccacgtaaggttagccctttcttcgttccctcaactattgtcaacatgattgccggtaacttgtctatcatgcgtggcttacgtggtcccaatattgcgatctctaccgcctgtaccacgggcttgcacaatatcggccatgcagcacgtatgattgcttacggtgatgcggatgcgatggttgcaggtggtgcagaaaaagcgtcaacgccactgggcatggcgggttttggtgcggcgaaagcactctcaactcgtaatgatgaaccgcaaaaagcgtctcgtccttgggataaagaccgtgatggtttcgtgctcggtgacggtgccggcatcatggtgcttgaagagtacgaacacgcgaaagcgcgtggcgcgaaaatttacgcagaagtggttggcttcggtatgtcaggtgatgcttatcatatgacttcaccgagtgaagacggctctggcggtgcgctggcgatggaagcggccatgcgtgatgcaggcgtgactggtgagcagattggttatgttaatgctcacggtacatctacccctgcgggcgatgtggctgaagtgaaaggcattaaacgtgcgttgggtgaagcagggactaagcaagttctggtttcttctaccaagtccatgacgggtcacttattaggtgctgcaggttctgtcgaagcgatcatcactgtgatgtctttggtggatcaaatggttccaccgaccatcaatctggataatcctgaagaaggtttgggtgtcgatttagtaccgcatgttgcccgtaaagttgagagtatggaatacgccatgtgtaactcgtttggctttggtggtactaacggtagcttgattttcaagcgcatgtaaaaacttcatcactctttacttgagttaagacggcttgatgcatagcattgagccgtttctttttatggagtgagagcatgtactgggtcaatggtcaacggcgtaatgaagtgcctattcatgatcgatcatttcagtatggcgatggttgcttcacgactatactgaccaaagaaggtcaggtgcagcaatggtcctcacataaggcgcgattacaggcctgtcttgatatcttgcacatacccgagcccaattgggatcgggtatggcagggactgcaaagcatgatcctgccgcaggagaaagctggactgaaaatacacatcagccgaggtttgggagggcgaggttacagtcctactcaagtgagtgaaagcattgttactattagcgcctttgcttttcctgcccactatcaagcatggcgtgataagggattggctgtggggatttgtcagcagcgaatgggattaaatcctctgttggcggggcacaaacataataatcgactggagcagatcctactcaaacgcgagatggataacgcgggatgggatgatggggtctgtttagacatcaatggcaaggtgattgaaaccaccgcagctaatatattttggtgtagagatgggacgatgtttacaccttgtttaagacatgccggagtcgccggtgttgcgcgtcgacagatactcgaactcgcgcagcaacaagagattcctattgtgattgatgaatttacgctggaagacctattgagtgctgaggaagtgtttattaccaatgccttacttgaggttgctccagtcacacaaattggtcaacaacgattgacgataggtagcatgacgcgacgatttcaggagagtagtaattcgtgattaaaaagcgggtattggtgttggttgctctgatcggtattgtggcaggcagctacttttatgttgttaagcagatggatcagtatctggctcagcctttgatgatccaagaggctcagctcgtcacgatcgcctcagggaccactctcagtcgagagctggcccagttaaccgaacaagcttggatccaagatagctttgttgccgaatgggtacgtcgttttcatcctgaactctccaaaattaaggcaggaacttacaagctacaacctgatatgtctttagagcaggctttggcgctattggtttctggtaaagagcatcaattttccatcaccttcgtggagggcagtcgttttcaagagtggcgggatatcctcgcaagcaacgaaaacatcacccagcaactgacgggtctgactgaaatcgatattgcgaaggctttaggcattgagcatgaaaagctggaaggtttgtttcttgccgaaacgtatcattttacgaaaggaaccagcgatgtagagatcctcaaacgagctaatcagaaattggaaaagtttctacaagtgacttgggagcatcgccaagagggactgccgatccagacgccttatgaggccttaatccttgcctcgatcattgaaaaagaaacctcaattgccgaggaacgcgaacgcattgcggccgttttcattaatcgtttgaataagcgcatgcgcttacaaacggatccaacggtgatttacgggatgggagagacctacgatggcaatatccgtaagaaagatttgcgtgcccgtacaccatataacacttatgtgatcaatgggttacctccaacgcctatcgcaatgcccggagaagcgtcaatttatgccgcactcaatcctgaacagagtgattatctttactttgtggcaagcggtgagggtggacacaatttctctaagacactcgcagatcataaccgtgctgtgcgtgcttatctcaaaaaacttagaacaaaacaatgaacgcaaaatttatcgtaattgaaggtcttgaaggggcgggcaaaagcacggcgattcaagtggtggtagaaaccttacagcaaaatgggattgatcacatcactcgcactcgtgaacccggcggtacgctgctggctgagaagctgcgcgcgttagtgaaagaagagcacccgggcgaagagcttcaagatattactgagttactcttggtgtatgccgcgcgagtacaactggtggaaaatgttattaaacccgcgttagcaagaggtgagtgggtggtcggtgatcgccatgatatgtcttctcaagcttatcaaggtggtggccgacaaattgcaccaagcacgatgcaaagcctcaaacagaccgcgcttggggatttcaaacccgacttaaccttatatttggatatcgaccctaagcttggtttggaacgtgctcgcggccgtggtgagttggatcgcattgaaaaaatggacatcagcttttttgagcgtgctcgtgagcgttaccttgaattagccaatagcgatgattctgtggttatgattgatgcagcacagtcgattgaacaggtcacggccgatattcgtcgtgctttacaagattggttgagtcaagttaaccgtgtctaatctcaattctctttacccttggttagttcccgtttggcagccttggcaagcgggattagctgcaggaaaaatctcgtcagcgacgttaattcaggcatcagaaggagtaggcgttgagagtttggttgaactcatggcccgcaccttgatgtgtacgagtagccaaagtgagccatgcggtttttgccatagttgcggtctaatgcaatcgggaaatcatcccgactttcatgttgttaagcctgaaaagatcgggaaatcgatcacggtggagcaaattcgccagatgaatcgtatcgcccaagagtcgtcccagctctccggttatcgcttgattgtgattgagcctgccgatgcgatgaatgaatcttccgccaacgcgctactgaaaacgctcgaagagcctgcaccaaactgtctatttattttggttacctctcggattaagcatcttttgccgacgatagttagccgttgccaaagattagtgctccctgcgccaaccactgcgttggtggttgagtggctaaaagggcaggggatcacgacgcctgcttacgccttacatctttgcgcagattcaccgctcaaaacccgtgcctttatgctagaagggggcgcggaaaaatatcatgagcttgaaagccaactgatgaatgcgctgagtggcgatgtgaatgcgcaacttaaatgtatcgcactcatcgatgccgatctgaccacgcatttgtattgggtttggtgtgttttgaccgatgcgcaaaaaattcactttggtgtgcagcaagactattatcccccagcaagtgccgcattagctggccgttttacctattctaaacttcatgtgcagacagcgagcttggaaaggctgatggaacaattgaaccagttcagtggattgaatacagaactgctgttgctgcaatggttatatcaatttagtgatgaggaaacatgtttgtagattctcattgtcatctcgacaagttggattaccaagacttacacgcggatgtcagcgatgtgctcgacaaagcgcaccaagccaaagtggaatatttactctcggttggcgttacgcttgattctttccctaagatgctcgcgatgatcgagcctttctcgcaagtgtatgcttcttgtggtgtgcatccactggatgtgcagagtgatttctcgctcgaccttttccaccaatatgcacagcatcctcgagtggttgcgattggcgaaacggggttggattatcattaccaacctgaaaccgccgatttacaaaaactgcgttttcggcagcagattgagactgcagtggctctgaataaaccgctgatcattcatactcgtaatgctcaacaagatactcttcaattactgagagaaggaaaagcgcagcagtgtggtggtgtgattcactgtttcacagaggatcttgcttttgctcaagctgcgatggagctgggattctacatctctatttcagggattgtgactttccgacaagcaaccgatcttaaagaggtcgtgaaagccttacctctggatcgtcttttgattgaaacggattcaccttatctcgccccagtaccgcatcgtggtaaagagaaccaacctgcttatgtggtcgaagtcgctgcctatattgccgctctaaaaggcgtttctttgacagaagttgcgcaaaaaacaacacaaaattttcaaaatctttttttgcgatgaaaatcatatttagataaaaaagcgagcgtttgctcgcttttttattcgtcaaataaataagaaattctaaataagcaggtgtttactgtatttgttgaaaaatagagcggaattcctcaaattgtaattttgttactaaaaataacatgcatatctattttatttacccagtaaaattaatgctatcaataattagttttatacaaaacatatgtttaggttgatttttgagttgaaaatgaaaggttgccgattgtgatctaattagtaatttgaaacttaatttcgtcgcaaactagaaaatttgaggggtatcaagatatatttagagccggaaaatataatgcaaaaagtggttacattttcactgggtgctaacatttaggctacgggggtatgccgttagtcccagcaattctaataacttaatcaggagcataaacatgtttaagaacgcttttgcgaatctgcaaaaggtcggtaaggcgctgatgctgccagtatcagttttgcctgtcgccggtattttgctaggcgtgggtgccgctaattttagctggctaccagaagtggtatcacatctcatggaacaggcgggtggttcagtctttggtcaaatgccattgctatttgcggtcggtgttgccctaggctttactaacaacgacggtgtatctggtctgtctgctatcgtcggttacggcattatggttgcgactttaaaagtcatggcaactgtgatgggtgtgagcggcatcgatactggtgttctgggtggtatcctagccggtggtgttgcagcttggtcattcaaccgtttctacaaaattcaactgcctgaatatctgggtttctttgcaggtaaacgtgctgttccaatcatcacgggttttatttcgattgcactgggtgtggttctgtcattcatttggccaccaatcggttctgcgatcgccactttctctgactgggcggcaaaccaagatcctgtaaccgcatttggtatctacggtatcgttgagcgttcactgatcccatttggtctgcatcatatttggaacgtacctttcttctaccaagctggtacttgtgtgaatggtgcgggtgaaaccgttaacggcatcatgacttgcttcctaacggctgacgatgcttctcgtgcggcaggcaatggcttcggtcaattggcaggtggctatttgttcaaaatgttcggtcttccagccgctgcatttgctatcgctcactgtgctaagcctgaaaaccgtgcaaaagtaatgggtatcatggcttctgctgctctgacttcattcctaaccggtattactgagccaatcgaattcgcattcttgttcgtagctccagtactgtacgctatccacgctgtattagcaggtctggcttacgttctgactaacgcgctgggcgtggttcacggtcataccttctctaacggtttcattgactttgttgttcaatcaccacgtgcagataacatgttactgctggttggcttaggcattggctacgctgtgctgtactacgtagtattcacattcgttatccgtgctcttaacctaaaaacaccaggtcgtgaagacgagagcgctgataaatcggcatcaagcggtaatgagctggctggtgatctggttgccgcattcggtggtaaagcgaacattactaacctagatgcgtgtatcactcgtttgcgtgtatcggtagccgatactgctctggttgatcaggataagctgaaaaagcttggtgcagcaggtgtggttatggtttctggtggtgtacaagctatcttcggtactaaatcagacaacctgaaaactgaaatggatgagtggatccgtaacaacggttaatctcattcttccccctagagaaaaggagaccttaggtctccttttttatgttttgaggaatctgccattgatccacagattcctcgtcgttctgtatccgtctttacgtggttaggatgaagccttgtccatcgctttctttatgcagatggctgcgccaccccatgtgatcccaagaccgataatcatcatgataattgcactgaatgtcattagtatgcttccttacgtgagcttgcattgatcagaatcccgatcaccaatagcgcagcgataatcgcccagccaagtgttaaatcgtagccaccgtaaccttcggtgaagagagcttgcagtttagtagcgacgataatcgctaagataacgggtgaaacaaagcgcaggcagatatcaaaccaaaccccaacgctaaaatcagagatgctgttgacgtatttacgaacatcagaaatcttcaatagccaagtcatcaataccagttccaccaaacagctggccatgatgcccacgttgttcgcaaagtggtcaaccaaatccagtagtagcaagcccccattggttgcaaaagccatggaaactaaaaagccaataccaataacgatgtttgcggctttcttacggctccaaccgagcttatcaatcagcgcagaggtgacggcttccatgatggaaatgtgtgagctcaaacctgcaacaaccaaggctaagaagaacaaaggacctaagatgtatgggattggcaacaagttgatcgccgctggtaaggtaacaaaagcaagaccaacaccggctgaaacgacttccgtcaatggttttccttgttcttgagccatatagcccaataccgaaaagatcatgatcccagccagtacggagaaaccacagttgatcaacacggtcataaaggcgttgttggtaatatcggatttctcaggtaagtagcttgaatacgctagcatgattgcgaagccgatactcagagtaaagaaaatctgcccataagcggctgcccaaacttttacatcccagattttgctgaaatcgggctggaacatatagttcacgccatccaatgcaccgggtaggaagatcatgcgagcgatcagaatcagcaccatgataaatagaatcggcatcatgatttttgatgcacgttcaatgccttttttaaccccacccacaatggctgcataagtgatgacccaagcaatcaacatagcaaatgcaatgtgccattgaatgctgcctaaatttgtgggcgagttatctcctaacttcaggtattcgctgaagaaataagcgttagtgtcgctgccccaactctgggtaaacgacataccaaagtaggaaatagcccaaccaatcactgcgacataataaacagcaatgacggctgcgatcccaacttggaaccagcctaaccactcaaattttgagtgaattttggcgagtgtcgttggcgctgaaccccgatgtttctgacccatactgaactctaggatcataaacggaatgcctgcagtgaccatggcgaaaagataagggatgaaaaatgcacccccaccattttcataggccatataagggaaacgccagatgttaccaaggccaattgctgaccctacggcggctaatacgaatccaacacgggatccccattgttctcgcttcataaacaactccttgtaatatcctagggtatgaagcttttcgtcagcagtcgctgaatctgggggaaaaggaggcaaagttatccgtacaatatttgcgcggccaacttttgctctatcatccatgattccgcaaaaagttagttatatatattggttgctgtccgaaaacctagaatttaattcttagttacgcgatgtgtgtttgcgaaatctgaaataatcagctacgcaatggttcgagactaccgttttattttgtaggtggcaatagattatataggttgctcgtttgttaattgtaggttgtattctttgggtttgggtgactttatcgaggattatggtgtctgattggtgagagttagtgaatctcactgagatcggtaaattgaactgatagaactatctaatataaaagaaagagtgtctgtctaaaaaacagccaccctttagaggatatgcccagttttgcgagtttgttaaaaattgggactaaaaagcggtcatcagaagcgaatggtaaacccgacataggctgtggcttggtttagccaatcggacttaaatttcaccacgcagctttctgacgaaggcagggtgcatatcgcgcttgaatcattatcaaccatggtgcccaaccagcgtaattgagcattcagtgcgacgttggaggcaatgcggtattcaacaccaccaaatgcactagcagaaaaaccgaatttcttatctgcccatgctacatcggtataagctccgccaatacctaggccaatgaaggaagagagcttttctgctactggatagtaaatgctgctttgaaaatgcagataatgaatagaggcatcttgattgactaaagtttggacttcggtaggttccgtagaataaaacaagccaattcggccgttgtcgtaggtagtttcaatagctaaagcgtagctgctggagttctcaagatcatattgacggccagcttgatcgagaactttgcctcccaaagtgtaaccgacggaaggcgtcaccatccactcagcagcagaaagtggcgcaaaaagcagaaataacgtgttgagaataaatagatttatttgacgcatatgcagatcctagccaagtgtttgacgaccaaggtattgtgatagtaactgcataatcgtgcacgaaaaatcagcaaatcttgaagatacttcacaccgatgttattactttgttgtataaccaaggaggtttctatggaacaagatctgaagtttgcgctagcaattgttgcgatcaccttcactgtgctgatcggctttggagtgattgcaattacacactagtcttgggtggtcctgcaaatgaagagtggtggagttgtttctgatgcaaggactgagctcgatactcagcgtctagccaaatacattggtggtaaacatgcactggttgcccaagggggcggccaaagaggtatttttacggctggtgtactggacgcttttctattatctaattttgacccttaccatgagttttatggcacttcagcaggtgccttgaatttgtgcgcctttttatctcgccaaaccgggttaagtaaagcctttattttagagctgaccactcgcgcagagtttttccatctatttagctacatccgacgtaaacaatatatgaatatgcagtgggcgctggatcggatcggtgaatacccttatcgcttagatttggacatggcacgtcaggctttaggtaagcgcaaggcttatgcggcagtcacatctgcggatgacttaaaagatgcttattttcctatgttaggcgcagattggcagcaagtacttttagcgacctgtgcgatccctggcctttatcctgagcctgttacgcttgcgggtaagcaatatattgatgggggtgtttcagcatcaattccggtgcaagaagcgtggcgtaaagaggctcgctttatcacggtgatccgcactgaatttatgtcgaaggaggaagaaacgccatctccctcagcgacggaattaccactgtggttgcgtgagccactgaaccatcttcaacaccagctacagcataagtggtcaggatggcgtcaagagtggaatgaattcctgcaacaacaaaagctgcgtgcaaaagagcagaaaaaagagcagaaacatctggatgccctgaatggtgggcgctggttatttggggctgatgatatttatcggctcagtcatttattgggtagcaagtttgatgcggggctggcggatttattaatggtccactatcaaacctatacgctgacttctgagtttcttgacgcacatcatgacgatacatttatcgcgcaaattatgccaagtgagcctttgcactcgaattcgttattgagttcaccagaggcgctgcaatatgactatgagctaggactgaaagcgggttaccgctttttaaaagcgtatagtgaagctgagactttccgcaaggaactcccccgcaatctgatgtgaggtaaagagaagaaggctatgcagccttcttcttgcgatgactaatagacaggtaagatgcgcatacagttggtggagccttcgactcccataatatcgccttgggtaatgatcacgagatccccttcttcgagtaggtttcgctctttgagggcatctaatgctgcaatggctgcttccagaccgctggcttgtttggtatcgaagtagaaagggatcaccccgcgcaataacgcgcagcgattgagggttgcttggttggcagacatcgcaaaaatcgggaatacggaattgagccttgaggtcattaatgcggtgcgtcctgattcggtgagcgtgaccatggctttaacgccttctaagtggttggctgcatagatagtcgacatagcaatcgcttcttcttccgtgcggaacacacttttaatgcgatagttttgctcattcgactcaatcatcttttctgcaccaatgcagacttcagccatcgctttgacggtttcaaccggatatttgcccgcagccgtttctcccgacagcatcacagcgtcagtgccatcgagcaccgcattcgccacatccatgacttcggcgcgggttggcatagggttactgatcatcgattccatcatttgcgttgcggtaatcaccacacggttgagttttttcgcgcgtgaaatcagctttttctgtacggcgatgagttcggggtcaccgatttccaccccgagatcaccccgtgcgaccatgatgacatccgaggcacgaacaatatcatcaatgttttcatcacaagagacggtttctgcgcgttcaactttggcgaccatacgcgcataaagcccagattcttgggcaaggcggcgcgcgaatttcatgtcttcaccattgcgagggaaagacaccgcgaggtactcaacttgaatttctgccgcaagtcgaatgtcatttttgtctttctcagtcaaagcatctgccgacaaaccgccgccttttttgttaatccctttattgttggagagaggaccgccgaccaagactttggtgtggattttattgccttcaactcgcataacttgtaactgcacacggccatcatcaagcagcaaaatatcgtcgttacaaacatcttgcggtagctttttgtaatcaatccccacgctttcttgcgtaccttcccctttggctaattccgcatcaagaatgaagtgttccccttcattaaggataattttgccttctttgaaagtagaaacacgaatttttggaccttgtaaatcacctaataaggcgacgtggcgaccgagtttggcggcaatttcgcgaactttctgcgcacggtttttatggtcttccgcggtgccgtgtgaaaaattcatccgaacgacattggctccggctcggataatggcttcgagaatttcagggctttctgtggaaggacctaaggtggcgacgatttttgttctacgcaaagttgagctcatatcattgttccttcgatgtgacagtaaggtatacccttcctacttaacgttgctgcggtgttggctgcctttgtccacctaatcacatggaatgtctatgctcatggggcgaagaaagtcagctttggttctcagccaaggcctctggcggctgcgcaaatgtgccgccagcctgcaacttcaagtagtttggatataagtatagtggcttagggaaattattatcctgtttatacctgttctgtttgatgctgctgatggtgtttgttctgtttgggtatatcgtacccatcaataaatggcagcaataaaggccaatatttggatataaaacacaaacttctaggtatatgcgtgatatttgtcacggctatctgacaaagaacttcacaattacttcgcaaagtaaaaaaattggtctgtcgttgaattccggagcgccgcatgtacatggctcaacccggccatattgatcatattaagcagatcaatgcgggccgcgtatacaaactaatagaccaaaaagggccaatctctcgcatcgatttatcgaaagagagtgagcttgcgccagccagtattaccaaaattacccgtgaattgattgatgcgcacttgattcatgaaacgacggttcaagaggcgatcagtcgaggtcgacctgctgttggccttcagaccaataatcttggttggcagtttctctcaatgcggctcggtcgaggttatctcaccattgctctccacgagttgggtggagaagtgttgattgataccaaaattgatatccatgaaatcgatcaagatgatgtgttagcccggttattgtttgaaattgaagagttttttcaaacctacgccgcgcagttagatcgtgtaaccagtattgctattacgttgccgggattggtcaattctgagcagggtatagtgctgcaaatgccgcactacaatgtcaaaaatttagctttagggccagaaatttataaagccactggattgcctgtgtttgttgcaaatgacacgcgggcttgggctttagcagagaaattgtttggtcattcacaagatgtcgataattctgtgttgatctccattcaccacggacttggtgcaggtattgtgctcgatggacgtgtattgcaaggtcgccatggcaatatcggtgagctagggcatattcaaattgatccgcaaggtaaacgttgccattgcggaaactacggctgcttagagaccgtggcgtcttcacaagcgattcgcgatcaggtcacggcgcgcattcaagccggagagcctagttgcctcgcgacagtggaagaaatttcgatagaagatatttgtgctgctgccgcagatggggatccgcttgctgtagatgtgattcaacagttggggcgttatttaggtgctgcgatcgcaattgtgattaacttattcaacccagagaaaatcttaattggcggtgtcattaatcaggcgaaatcgattctttatccctctattgagcagtgtattcgtgagcagagtttgccggtttaccatcaagatttgaagttggtcgagtcgcgtttctataaacaagcgaccatgcccggtgcagctttgatcaagcaggcgctctatgatggtctactcttaatgaaagtggtcgaaggataatctgccattcccatacaagaagtaagaatttcagctttgcttacatttacatttatacctagcggctatactgttacctaggtagtcatttaacggaatttcgtatgtcaggtgttttgaacacggtagaccagcgtactaatctggtcggcgaaaaccgattggagctgttactgtttagcctcaatagtcgtcaaatttttgcgataaacgtttttaaagttagagaggtgatcaaagtccctctactgaccaaaatgccaggctcgcatcctcatatcactggtgttgcgtcattacgtggtgaaccagtgcccgttatcgatttacgatctgccatcggttttcctcctcgccgtgttcaagatacggaacaaaacctaatcattactgagtataaccggacaatacagggctttttggtggggcaggtgcgcaacatcatcaataccgcatggacggaaatccagccgccacctaagtcggccggaagggcaaactatctaacggcattcacgcatgtcaaagaacaagacaagacacatattgttgagatcattgacgtggagaaggtattagcagaaatcgtccattatgatgcctcaatatccaaagaagtattggatgagagcctactcaaccatatggatggtcgaaccatattgattgtcgatgattcttcaacagcacgaaatcaagtgaaagatacactgtcccaattaggtttaaatatcatcgaatgccatgatggcttgcaggcgttgaatttattgaaatcttggtgtgatgaaggtaaagacatctacagtgaattactcatgatgattacggatgctgaaatgccggaaatggatggttataagctgacttatgaaattcgtaatgatccgcgtatgaaggatctctttatcacactcaatacctcgctcagtggcagctttaatgaagccatggtgcaaaaggtaggctgtaaccgatttatttctaagttccaacctgatttgctcgtacaagttgctcaggaaagattgcgagaagtgctttcctaagcatataggttgaaccgatagcattaaaaaggcactcatcgagtgcctttttaaatggtgttgattggcgagtttacaatacggctaacagaatgccgcctatggttgccgcagcggaaagatattgcccagcagagtaggaggtgtcctcaacttctttcactttttcggggtgatccatgcccaaagcaccataagtgaaagcttcaactttatcgccgacagttttatctttgctttctagcgctttaccttctttttcaatttcctgtaaagcggcaagcagcgctttgccttcctcagacaaggtgactttgttctgctctactttgaggggagcaggagccgtatctggcttagtaggtgtctgagatttaagcgtagtgttggatggcaacgtgtgcacggatcctgcgcctattgggttcatacatctctcctaagtcatcactctgaaactatatcgaccacaaactaaaaaacttgcgtgatttttacactttatgtgtgaaaaacaggcaagcaaatgctgtgcctgttttgagtgtttgacggcgaggaggagatgtttattcgcaaacgagatctgtgttgcgatttttcaatgcattaatcgcttcggcttgatgcgctttttgcacataacgcacaggtggcgtgagtacttgcagttgataatcatcactttgtggcgagatttcaccgacaggagtgatgatgacaactttgagatttgggttgcgacgcaaaatcgatgccgccgtgcctaaaccctgctgagtatggaacatgccggcgatgtgtagaactttgcgttcaggattggccgcaagatagcgcacaatgctttccgccatggtctcatcccaagtgacttgcgccgcatattggttctcattttgtgctggattgccatggtgcattgaagccataaaggtgctcttgtatggcgaatcttgaatgttaacttcggttgcgacccattggcgctgttcggggcttaaacggtcaagataatcaatccctactcggccaatgcaacgcacgataggttttggggcattggcagcaatcacgggcaactgttggcttttcgcaaactcgaccaaagggcggtaatcactttcgtaattaggccaagcattcgccttttggatcagatactgctcaccaattttcccagtgagatagtcatccatcaagggttgagcatcacgggtaaactgttccatcgacagtaccatcggatggccattttccgtcatctgcttaagcaaatcagtctggaaacggtggatacctgcgtgggtatgccattcaccgaccaggattacgtcagcgttttcgatttcagcaggcaatctctgtaggctgatccgctcaccagttggcgtcgccaattgatagtcataaaaggtactaacttgcgttggagtggctgagcagccgagtaagctgaaagaaaggaaaagtgccgcaatagtgcgcataagaaaggcctccataaaaattgcgctcatggtaatggaggcgactgacttatgcaatcaatgagaatcgttatcagttattttctgcgatacactcggagcataaaatcggcttcacattcgaaagtatcactttgactaacacggtgtttaaaatcctcactggcacgccaagcaaacggagtcatttgcagcaagtctgccgcttctgagccattgagtgccatagggtagtggagtttacactcttcaaccaattcaaaacccgacagagtttctggttgctcttcatgtaaacgcacctgatcgtagatgccttgtttaaattgatacaggtgacgtgccgctggcgtgacggtgataacgatgccgcctattttgatacaacgctccaattcggtgtctttgcatggtgcgtaaatacggatcacgccatccagactctgattggcaaaaggtaagcggtggctagaggctacggcaaactggcactctgggtagcgtttggccgcgtagcgtatggcgattttggaaatatcgagcccaaaaatttgtgcttcactgtcttgctggcgcaaagccttggcaaaaaaatcggtgtagtagccttcaccgcaaccaatatcgagcagcgtttgctggcggtccgttaaataggtttggcacaatgtggcaactttttcacgcatgggcgcgtagtggcctgtgtgtaaaaaacggcgacgagcctgtgtcatctctttgttatcaccgggatctttggagcgcttatgctgaacaggcatcagattgacgtacccctctttcgctacatcaaattgatgacgattgatacaggcgtaagtattttggtttagcgttaggggatgctcacacagcgggcacaaaaaggtcatggtggtctcaatcaacaaaatagaggcgtaagtttaacggcagccgcgcgaaatacaaagcgcaacccagtctcttaacgcggttgatgttgactgctcgagggataaaggccgctcaaaggcttgaacggccttacagttaaagagatcaacattaaaaattgaaggcgacacccgttgaaaggaaggttgattgttgatcaaaaaagttcaccgcatcatcggtttcactcagtcctgccatcgcgttaatcgagacattttgccaaccaaagggcgcgcgatagacatacagcgcaaaggcgctccagcggtcggcatcacgggttttcgcaaaaatcgggtgtgcggtatcgtactcttcttgtccataactgagggttaaaaacagcgcttgtgggccgaaaaaggtattcacaccgagttgatagtccagcgccgtaaaatcaaatgcatccccttgagcatcacgttgggtataggtgatttgcgggactaaagaccaagagcggctcagagctaaagagatttcagccgatacttgttgatactcactgttgcgattgagtaacgcacgttgcgtattattgaggccggatgtcgcaccgctttgctcttcatcgactttgtaatctaagtaggcataacgcagagtaattggaagcgcgaaaggcgcagtataagcaaggcgtcctccttgtgcgctgatgtcggtcaccgctcttgccgtctgcgttaaatagggatcgcgccaagtttcattaatcccaggcagcgaaggaaaataagcgagtgtaatttcacccagtctctcaaatcggtgggtgatacccagttccgcttgtagttgtccctcgatcacttggtcggtactttgaccggcaaaaagctgagtatttcccgaggcaaaggtgtattgcacattcccgagtggtgcaaacaggagctcggaagtggaggtacctgattgctgtaaatccgtggtgatcgcgttgtcatcattggtgttcatttgcgatttatcacgcacgtaaaagctgttaagactcagtgtgacatcccaaccaggctgatttctatcggttgggccttgagcataagccgctggtggcaaagaggcgacaagcaaagtgagtagactggggtaaataatgttcattaggcttccttaccaaatgtgtgcgttatcccccttccgacttgaagctgcagcggtgtgggctacgttcgttcaccccaatcacatagtttatctatgctcatgcggattcactcacttgtcgcctaccagcaactctaagtcgtttgggtatatatcaagaggcacaattataccgagctaagtcctgaatgccatgacgaaaagatgaacagaatgtggatcgctcagtaaatttgtcaaaaatgaaataagcagcacccgcgttgcaatccagaatggatatacccttcctacttgaagctgcagcggtgttggctgcattcgttcaccccaatcacatagcgtatctatgctcatggggattcactcatttgccgcctacctgcaacttcaagttgtttgggtataaagtgctgcttatattgagaggactattgagcttggctagtgatttgagtgactagctgatgattttgccccggctgtaaggtgataccctctgccaaagacggcgcatgcagtgttgattccacacacaaaaagtgtaagtaaccctcatcattcatgtcggccatcgattgagcaccttgttgccaaggattccacaacaccgcggagttatgaccttgattttcaacggttagcgtgcgagctaatgcggggtcttgcactgtgatcaagggttcgggttgcgtgtaaacacggtctatcgtgtcagtgagagtgagcaaaccgtgctgagtacatagacgactgttttgtaggctatcaatatactccgttcccacacctgaggtttgcgtttcacgaatatcacccacgtgcagataagtgtgcagagccccagagaaggtccatgcttttgaatccgtgttagtcacatcaagtgtcacagtcaagctctcacggatttccacgtgcaatcgaacgtcaaattgatatggccaaatggctaagctctctggcgtggcttgcaagccgagagtgacgataacgccttgctcattttccctgtgttcgatcagtttccattcttggttccgtgcaaaaccatgtgccggggcggcaatacgaccaaaccatggccagcaaaccggaataccaccgcgtagtgcggctttgccatcgtaaatagcttgtgagctcatccacagcaagtcagcttgaccttttggctgaaaggagaggacatggccaccgtgtagtgagatagcggcgctggctttgtcatgaatgacgcgtacgattttgacttgatcttgctcagctatggtgacgcaatcagataatgttgtgacggttttcaaagagagtaaatccatcttagtttccttgagtctgcgttttggctagctctgagatttggtgaaatagcgagcaaaagactcggaaacaccaatactcagataccaaaaaggcgaccctagagtcgcctttttgtctaacgaatttcttcgctaatcactacattacttagagatgtgagcgatcaggtcaagaactttgtttgagtaaccgatttcgttgtcgtaccaagatactactttaacgaatttgtcagtcagtgcgatacctgcgtcagcatcgaagatagaagtgcgagtgtcaccgttgaagtcagtagaaactactgcatcttcagtgtagcctaggataccagccagttcgccttcagaagctgctttcatagctgctttgatgtcgtcgtaagacgctgctttttgcaggttaacagtcaggtcaactacagaaacgttagcagttggtacgcggaaagccataccagtcagtttgccgttcagttctggaagaacaacgcctactgctttcgctgcgccagttgaagatgggatgatgttttgagaagcaccacggccaccgcgccagtcttttgctgaaggaccgtcaactgttttttgagttgcagttgttgcgtgaacagtcgtcatcaggccagactcgataccgaagttgtcgttcagtactttagcgataggcgctagacagttagttgtacaagaagcgttagaaacgatgtcttgacccgcgtaagtcttgtggttaacacccattacgaacattggagtcttgtcttttgaaggaccagtcagaacaactttcttcgcgcctgcttcgatgtgtttacgagcagtttcgtcagttaggaacagacctgttgcttcagcaacaacgtcaacaccgatttcgccccatttcaggtcagctgggttacgttctgcagttacacgtacagttttgccgttaacgatcaggttaccgtctttcacttcaacagtgccgttgaaacgaccgtgagttgagtcgtacttcagcatgtatgccatgtaatcaacgtcgatcaggtcgttgatacctacaatttcgatgtcattgcgctcttgcgcagcacggaaaacgaaacgaccgatacggccaaaaccgttaatacctactttgatagtcattatagttgctccacaacttaatttctgattaaagataactggtagtaaaattacagaatccagttaaaagctgcaacagataatcggacttaacttgtttaaagtcaaaaaaaagcgtcgctttttttcacaatcgtttgcaactgattaacttttaaacttgagcctgctttttatgcttaccaattgacgtagaatgtggcgatggttaagtaccgcacacactaaaaaatcttgctcaaaatagagtgaaaaagtatgtgccacaaactctgaattaggcaagtttttcacaaaaaatggtcagtgaagcgataagtaaaaaggaaatagaaagggtgaaattcgaatcaaaagatctgcacaagcctgatgaatactggcgtgagcacctgacggaagaggcgttttatgtctgccgccaacaggggacagaagcaccatactcaggtaagttgttacacaataaagacacgggtctttaccactgtacctgttgccaaagcgctctgtttagctctgaaaataaatacgattcgggctgcggttggccaagttttgatgcgccgattaatgaacaggtgatacgctttttggatgactttagtcacggaatggtgcgtaccgaaattcgttgtgcagcctgtgatagccaccttggacatgtttttgaagacggtcctaagacgacaggattgagattttgtgttaactcggtgtcgttaattttcaacaaaaagtgaatattgccagacgacttggagtgttaggtgggtgccaagtgagttcatccccgagcaccaataggttatgcgatgggaaataaccgccgtcaacagcgctgcatctttaagtcggaagggatcagcggccaagaaattcgccgctgatttccgaggcacttcacccttcgttaggtttaggcagggtagtcttggtgtaactgccgttacggatcgttttagcaatcgtgctggcagtatcatccaatgcggcaaacttctcttggctaaaaccgtaaagccgtttcatttctgttgtggacgcaaccgaaaccccaaactctttgccaatcattgcccacagataagcatgctctttatcatgcagagcatggtagttactggctaaggctttcaatatctcaatattgacgggttgaccattgctgagctcaagtgttttatgcagcagctcgatggttttcggtttatcgcggtcagtgtaaaaagtggcgagggcgtactgcatctcggccgtttctaattcaggcttaccttccaactgcaaaaaggcacgccgcgccgcgtgatcaccaatctgactccacaagaaatagagtgcttgtggtgaattggattgtttcagttcagccacgatacgttcttgctctttgcctgaattgaccaaagcattaaagcgattctcttttagcttcgtttgatcaatcgcttggatttgcgaagcaagctcaagacattttcgataagcactgaccaaatggtattctttgatgcttttttcatcgctcggtgatttcaaaatttcaaagcggtgccatatcagatcggttctgggaatgcggcattgcccatcatccatattgagctgttcacagcgcagattggggttgtcggcacagagcttttcggtgttcttgcgattctcgaaacagccacttaacagcactaggcttgcgagaataagtaatggtttagtcaaattcatgatatcggcttgtgatcaaatacacttatttatttagctgttcttgacgcattacgctagctcgttatgttgacgccacatcacttttgagcaggatgagatcatggacacccaacaactgattaatgcgattacgcctgaagcttatcagcgcctactgtacgccgtagaaacgggcaagtggcctgagggtacaccactttcacaacagcagcgagattcctgtatgcaagctgtgatgttgtatcaatctaagcataatacacaggcagaccatatgtcggttggcgtgggaggcgaggtggtttttaaatccaaagcggaactgaaaaagcgtttttcggaaggggaagaggatattctgcgcgttaaccccaaccaagaggcataaataatcctcaatctaataatgagcctcgcattacgcgaggctcattggcaaccatgttaaatgggggagatcgcttttcgatcttctgcttcaaccactacagcgtcatttcaccacgtaacacttgctgcattttggctttcacttcttcataggaaaggttctggctgagtagataatgcagtttggcgagcgccgcttcaggcgtcatgtcatagccactgatcacgcccgcatcagccagtgcacaacctgtggcgtagccgcccatattgactttgcccgcaagacattgggtcaggttcaccacaatcaccccacgttcagaggccgctttgagctgagctagtaactcaggattctgcggtgcattgccgacaccgaaggtgagcaggatcatcgcattcacgggttgcaatagggtattgcggatcacctcatgagaaatgccggggtacatggtaatcacaccaatcggttgtggcgtgatcgggttgactttgaactcaccactcggtttttcatccactttgacgttggtgctcaattcaatattgatgcctgcttccaatagaggtggtaggtttggcgagctgaaagcactaaaaccgtcggcgtgtgatttccggctgcggttgccacgcatcaaacgattattgaagaacagagtcacttcattgatagggtaattggctgcgacgtgcaaggcattgagcaagttggcttggccgtctgaacgcagatccgccagtggaatttgtgagcctgtgacaatcacaggtttgcctaagttttcgaacatgaacgacagtgctgaagctgtgtaagccatggtatccgtaccgtggaggattacaaagccgtcgtatttgtcgtagttggccgcaatatcgtcagcaataagctgccaatcagcaggcgtcatgtcagatgaatccatcaaaggatcgtattcatgaatggtaaacagaggcatttctggacggtgaaactcgggcatgctggctaattgcttttccataaaccctgcaacaggaacgtagccgtgatccgattttttcatgccaatggtgccgccagtataggcgatataaatatgttttcttgccatagcgagaaatcactcagtgtagggaacagagcggcgattatagcgaaaactcttgcaataaaaagaggcgcttcttgcaaagcgcctcggtatatcaagggttgtgaccgcgtagactattctacttggcagggcagacagaacgcatattgccctttaggatcattcaattgattgagcagcgacgtttgttgttgccactctactgccaagggttgcagtgattttggcaagagagtggagacatccaaacctaagctgacacgtacttgtccgagcagatcttgtaaaaattgctgggctggagtgagtggctcttcaacccagtacaggttatattgatccaactgtgccagatccgctgccaaatgtacggcatcatcaaaatcacccaactgatcgactaaaccgagggtttgtgcatcttgtgcagtccagactcggccctgagccagttcatccactgcttttaaggtcaggccacgtttctctgcaaccaaagaaataaagcgctgataaccgtgttcaatacccagttgaatcgcatcttttgcaccttgggtgaggcccgtggtcaggccttgtcctgaaaaaggcgttgtaccaacaccatcagtataaataccaaggttgttcagtcctttctcgaaggtagtgatcacgctgaaaataccgattgaacctgtcagtgtggtcggttgggcgacaatcttatctgcgctcatcgaaatccagtaaccaccggaagcggcaaggcttgacatcgacaccaccacaggtttccccgccgctttcagagcttcaatttcattgcggatcacttcggaagcaaacgcgctgccccctgggctatcgacacgcagtacgaccgcttttacattgctgtcgttacgagcttcgcgcagtaatccagctacggtatcgccacccacggtaccacgtggctgtgagccatccataatcgcaccgctcgcgacgacaacggcaatatcgttggcatcggtcagtgtcgttggcttaatggtggttttgtattcgtagtaaccgatggcgttataactgtcttttccatcgctaccaaaagtttccgctaacgtttggcgaacttgctgacgagtcgccagttcatcgacgagaccgacttttttggacagtgcagctaagtcaccattcacttctttcaactgagcgacaaactgctccatgcttggagtaagggttttgatctcaatttggcgattggccgcgacatcatcgacgtacgcgctccacaactgagtgagccagcgagaagcggattcacgagccgcatcagacatatcatcacgcacaaaaggctcaattgccgatttgtaggtgccgacacgaaagacgtgagtggtgacatccaatttctcaagcagagttttgtagtacatggagtaggcgctgtaaccttttagcagtacggcaccatctggagcgaggtagattttgtccgcataactcgccaagtaatattggctctgattataaaaatccccaaccgcaaacacaggcttaccagaggctttgaattcgttgatcgctttggcgatataacgcagcttagtcaagttggtttctggcatgtctcctaaagccaacacaagcccggtgacattgttgtcatttttcgcatggcgtaaggtttcaacaatatcaaacagcacgttttcgcgggggagctcttcaccaaacacggagcccgtaaaggagtccatcgggttgatgtgcgtactctgctcaacaatcgggccagacagattgagcaccagtgccgaggatttatccatggtgggtagcggggcgtcagcgtggacataaataaagtaaataatgccaatactgagtaagaaaataaggttagtcagtgccagcctgatgaaggtgatcgctttccaaatccctttcaaaatcagcccaacaaaacgaaatagtgatttcatggtatctccagaccaacggagtggcacaacactccaaagcttcagatgtctagtgcatatcagcgcacaacgaaccacatcctacgttatctgatcggggcaaacaacaatcttgcaaaccagcgtaaccttgatcgctgttacacaaatgtaaacacttgtttgatttttgtaattggcaagaatattctggtcagaccatatcaataagaagcaaagtgaagtcgctatgtacccaaatctatttcagcctctcgatcttggttttactcagctcaaaaatcgtgtgttgatgggctctatgcatactggcttagaagaaaataaggaagggctgcacaagctggcggccttttatgaagaacgtgccaaaggtggcgtaggcttgattgtgacgggtggcttttcgcctaacttgcgcggccgtctgcacccattcagcgctgaatttagcaaaactaagcatgccaaagcccataaagtggtgacagaagcggtgcaccgtcatggcgctaaaatcgctttgcaactgctgcatgcggggcgttatgcgatgcatccattttcacaaagtgcttccgcgattcgtgcaccgattgccaagtttgccccgagtgaaatgagcactcgccaaatccgcaataccatccaagacttcgccaatagcgccgagcttgcacaactggcgggctatgatggcgtcgaagtgatggggtcagaaggttatttgattaaccagttcatctgtaagcgcaccaacatgcgttacgacgagtggggcggcagttatcaaaaccgcattcgttttccagttgaaattgttaaagctatccgtgaagcggttggcaaagagttcatcattatctttcgtctgtcgatgctcgatttggtggagcagggcagcacttttgaagaggtggtggtgcttgccaaagccttagaagaggcgggggtcaccattatcaataccgggatcggctggcatgaagcgcgtattcccacaatagcgacccaagtgccgcgtgccgcctttagctgggtgacggagaagatcaaaccctatttaaaagtgcctgtcgtgacctgtaaccgcattaacacgccggagcaagcggagaaaattttggcgagtggtcaggcggatatggtgtcgatggcgcgcccgtttttagccgatgcggattttgtacgcaaagcgcaagaagggcagagcgcgctcatcaatacctgtattggttgtaatcaagcttgtttggacaacgtctttcgtggcaaacgtgccagctgcttggtgaacccgcgcgcttgttatgaaactgagattgtggttaaacccgcacagagcaaaaaaattgcggttgtcggtgctggccctgccggtttagcgtttgcgacgaccgcttcagagcgtggtcatcaagtggatctgtttgaacgcaatgacagaatcggtggccaattccgtcttgcgatgcagatccccggcaaagaagagtttcgggaaaccattcgctattttgctaaccggattgatcaaactggcgtgaagttgcacctgggttgtgaagtgcaatttagcgatctgcgtggctacgatgaagtggtgatcgccacgggcgtgacacctcgcaaaatcgccctagcggggctgagtgaatcatcaaaagtagttgattaccaaaccttaattcgcgaaaagacacccgtaggccaaaaggtcgcgattgtcggcgctggcggtattggggtggatgtggcgagcatgctcaccgagccgaaagatcaaactttagatgattggttatacgaatgggggattgataaagccatcgagcaccccggcggtttgtacccatatcctgagacaaccagtgagcgtgaagtctggctgctgcaaaggcgcaaaggcgcggtgggtaaagggccgggtaaaaccacgggctggatccataaacgcacgttagaaaaacgcggtgtgcatttggttggtggcgtgcagtatcagaaaatcgatgagcaaggtctgcatattgagcgtgatggaaaatcagagctgattgatgctgatagtgtggtgatttgtgcaggtcaagaatccgtgcgtccttttgaggcgcagtgggctgagctgggcgataagctgcatgtgattggtggggcggatgtcgccggagagctggatgctgcgcgcgcgattcgtcaaggtgtggagctggcagttcgattgtaacttgttgagtgaaaaccatgaacggcaaagggcacttcggtgccctttgttattgtctactgctgagggttcgttacaaaatgacggtcttgttgccgtagacaaacacatgatcattcagcactttgttgagagccttactgagtacattcttctctacatcgcgcccagcttgcgccatatcttgcgcgctaaaggtatgatcgaccggaatcacgtcttgcttgatgatcggcccttcatcgagatcgttcgtcacaaaatgcgctgttgcaccaatgatttttacaccgcgctcataggcttgctgatacggcttcgcaccgataaaagcgggcaagaaactgtggtggatattgatgattttatggtgaaaacgctccacaaacgcaggtgtcagcacacgcatatatttggcgagaaccagataatctggctgatattggtcaatcacatctaacagtgcttgttcgtgagcttcacgcgacaaaccttcatgggacacacagtggtaaggaatatcaaaacgctcagtcaaacgttgcagtgtgtcatagttgccgactaccgcagcaatatccacatccagactaccatcgtagtttttcatcaaaatatcgcctaagcagtgcgcttctttagtcaccagaatgacgatgcgtttgcggctcgaactgatcagtttacgcctagtaccttgaggtagagcatggtcgaggtcggccagcagcgttgcgtcattgaaataaccttccaattcggtacgcatgaaaaaatgaccgctggcattatccacgaattcattattgtggatgatgttgagttgatgcttgtaacaaatattggtgatcttggagatcagtcccggcgcatcaggacaatgcgtcagcagggtttttttttccattgataacaacttccatgcaaaaataaaaatcccctttctctttgaaataacaaggctattttttgccatttcagccagtctggggctagcgaattttttcattctaaaaaacaaatcggcggcggctgaacggtgagccagcccgcaaatacgcacctataattaatctattatcaagacagattcaatcgctttagccaagtaatacttaggttcattgtgcattgagtaggtagtttcttattgttgagagtagtaaggggtcggatatggataaagaacttctcgcacgtaaattgtatgtcgagcgggtagaggcactgctcggggatcagcctatggatgagcatattttggaagagatgtgggaaaaccgcgcttctccttctgaagcagccaaagccatgaccatcaccccgacatcgggttatgatgctccaccttggcttgcccgttatctcaatcgcaagtaaatctttctctgcggtgtgaatgagattgtcattcgcaccgctgctgaaaacctgccataatcgcgccatttccgttgcacaacgaactggcatgattgaaaaaaccttttcccagcaaggcgctttaggccaagccattccgggctttcaacccagacaagcacaagtcgatatggcgaaagcggtcgccagtgctatcgccaaccaatctcaattagtggttgaagcgggtaccggaaccggcaaaaccttcgcgtatttagtgcctgcgctgctcagtggcaaaaaggtgatcatcagtaccggttctaaaaacctgcaagagcagcttttccatcgcgatttgcctttaatggtcagtgcgttaggctttttcggccaagtcgctctgctcaaagggcgtgcaaactatctctgtcttgaccgcctaagtcggcaaatggtcgaaagccatacccccgaatctgatcccacgctgctcactcaactggtgaaagtacgcagctgggcatccagtacccagagcggcgatttaggtgaatgtgatgatttggcggaagatagcccgatcatcccaaccattacttcaaccaacgacaactgcttagggaaagagtgtgccagctaccaagactgctttgtttccaaagcgcgtcgtcgcgcgatggatgccgatgtggtcgtggtgaaccatcacctatttctggccgatttggcgatcaaagagacgggctttggtgagttaattcctgaagccgaagtgtttattttcgatgaagcgcaccaactgccggatatcgcgagccaatattttggtcagtcggtatcgagtcgccaagtgcaagatctggcgaaagatattgaactcggttatcgcaccgaagcgaaagacatgcgccagctacaaaaagtgtcggataagctagtgcaggctgcgatggatttgcgcattgtgcttggcgagccgggctatcgtggcaactggcgtgaagtgctgaaagtgccgaccgtcgcaagggaagtggaacggctcaatgaagcgctgcaatttgcgttggatgtgctcaagctggctttggggcgcagtcagcttctggatacggcatttgaacgtgcaactttgatcttaggccgcattcgccgtgtgtgtgatgtttctgtcactggatattcctattggtatgacaccacgccgcgccatttcagtttgcatattaccccactgtcggtagcagataaatttcgtgaacagattgcgctaaaagagggcgcgtggatattcacttccgccaccttagcggtcaacgaagatttcagccattttactgagcggctagggctgacgccgagtgcgcagttttcgctggtcagcccatttgattatcagcagcaagcggtcttgtgcgtgccgcgctatttacccgagccgaacagttccggccttgctgagaaactggtacgcatgctcgcgccagtgatcgaacataaccaagggcgctgtttctttttatgtacctcgcacagcatgatgcgcgatctaggcgagcgttttcgtgaacgtttgaccttgccagtgttgatgcaaggagaaaccagtaagcagaaaacgttggctgaatttatggagctgggcaatgccctgttggtcgcaactggtgctttctgggaagggatcgatgtgcgaggcgacactttaagctgtgttatcatcgacaaattgccgtttactgcaccggatgacccgttgctcaaagcgcggattgaagattgtcgtttgcgcggtggcgatccatttgcgcaggtgcaacttcccgaagcggtgatcaccttaaagcaaggtgtggggcggctgatccgcgataaaaatgataaaggcgcgttgatcatctgtgacaatcgattggtcacgcgcgattatggtggcgtgtttctcgccagtttaccgccaatcccacgcacgcgggatctggacgtcgtcaccacttttctacaacaattagctataactgaaatcaatcagagagactcatgagcgtaaaaattctcgccttagatacggccaccgagcgctgttccgtcgcgctactcgtcggcaataccgtttattcacgcagtgaaatcgccccgcgtgatcacaccaaaaaagtattgcctatggtggacgaagtcttaaaagaagcaggcgtaacgctacaagaattggatgctttggcttttggccgtggcccgggaagttttactggggtacggattggcattggaattgcacaaggtttagcctttggggcagatctgccgatgattggcatttcgaccttagcggcgatggcgcaagcggcgtatcgcttgcaggggttaacccatgttgccagcgctattgatgcgcgcatggaagaagtgtattgggggcgctatgtgcgtcaagaagatggcagttggcaagtcgcggaagcggagtgtgtgattgcacctgcgctgttagcgcaaactttgacccaagatgatttaacccaagatgagcagatttgggcgaccgccggaacgggttgggatgcttatcccgcactggcagatctgccgttgcaactgcaaaccagcgaagtgctttaccctgatgcgcaagatatggcttatttggctcagttcgaattagcgcaaggcaataaagtgagtgtggagcaggcaagccctgtgtatctgcgcgatactgtggcttggaaaaaactgccgggtcgcgagtaaggctaaaaccgtcaggcagaagataagcgcttactcactcgcaaacgaataggaacagtatggtttcaattaatggattacctccggcgcgactgcccggcaccaataaaacctcgaaaacggggaaaaagggcgaggtcagtcagagcgagagtggcaaaagcgtttcatcgaccagcaaagtcgcgacggcggtagcggaatcgatccgtcaggtcaatgagtcagatatccatcgcgcgcaagtgcagtacgatttgcctgaagggcggggtcgtaaagcgatggaagagtacctgaatgtaatgaatcaagcgcgcaaagaggaacttgcgcagctacttggggtcgatatctacatctaaaactgaggtgaattcgatgaagatgcatgtgctgaaattactcatacctaccatggctctgctgctgtctgcttgtgcgagcttgccacctgagttgggcaatcccgatgataaaagcgttgtgactcaatattcggcttggctcgagcgcgatccagctacgcaatcacccgttcgaatgggtggcgttgttgccaacatcagcaaccaaaaagatcgcacccgcgttgagctggtcaacttaccgattgatagcgcagggcgtcccaacatccatcaagagccacaaggtcgctttgtcgcttacgtgccgggattcttagatccaatcacttatggggaaggtcgcttgctcacgctttatggtacgacagcgccatctgaacaaggcaaagtgggtgactatgaacacacttatccggtgatgaatgcgcaaggttaccatttgtggcgagtggaagagcgagtcgaagtcgatgatattggcccttacatgttcccttgtcgcggtttctactgttggccaaggacgatgcctgagcgggacggtaagatcattcaagaagttaaatgaactctatttcaaccacttatctgctcgaacaaggccaattagcggccattgaagtgggcaatgcaaaaatggccgaagtctcggtcatttttattcacggctggctggataacgcggcgagtttcttgtcactgatgcctgcgttacatgcgttggatcctaagctgcatctgtgcgcggttgatctgcccggtcacggtttctctagccacaaagcgggttactctgcatttcacgactatatcgatgatctcgatcagctgttgctcaacttatcgccaaacaaaccagtgctagtggggcattcgcttggtgctttaatcgcaagttgttatagtgccgcctttcccgagcaagtcagcggtttagtgcagatagaaggcttcggaccactctctgaacctgccacgcacagtgtcacgcgtttgcggcaagggatacgctcgcgccatgcgttacgcaacgcaaaacctcgtgggtatgccagctttgaacatgcactgcgtcaccgtgctttggtcaatcagttaccggctgaattgctgcgtccgttggtcgaacgtggtacttatcagcatgacgagcagtggttctggcggcatgatcttaagctcaaggcggactctttatatcgcatgacgccggaacacgccgcgcaggtgcgcgaatcaatccattgtccgcagcaggtgattttgggctcgcaggggtttgccacactcaagcaacaagcacaaaacccagagtttgcgaccatccatatagcaacggtgacgggcgggcatcactgccatttagagcaacctcaagcggtcgctgaattgatttttggcttagttaacaaaatttaaacaagtgtttgagagttacgtgctcaagcacctcggctgtgctgtaatagcggtcagcatttgcatgactactgcatgatgacaacaacaagaatagcgccagccaataacgaggagtattaccgtggataaaccttggctttcacgttatccgaaagacgtaccggaaaccattaatcctgatcagtacccatcactggtcgaaatgtttgaacaatcggtacataagtacgcggatcagccagccttcatgaacatgggcgcggtgatgacattccgtaagctggaagagcgcagccgcgcctttgcggcttatttacaaaacgatctcaagctgaaaaaaggtgaccgtgtcgctctgatgatgccgaacttgctgcaataccctgtggcgctgtttggtgttctgcgtgctggcatgatcgcagtgaacgtcaacccactttacactccgcgagagctggagcatcaactgaatgatgcggatgcgcgcgcgattgtgatcgtctcaaactttgctaacaccttagagcagatcgttgccaatacacaggtcaagcatgtggtgctgaccagtcttggacagatgctgccacgcgccaaaggcacaattgtcgatttcgttgtgaaatacgtcaaaggcatggtacctaagtacgatctaccgggcgcgatttcgatgcgtaaagcgctgcacaaaggccgccgtctgcaatacgtgaagccgtttatgtccggtgaagacattgccttcctgcaatacactggcggtacaaccggtgtggcgaaaggcgccattctgacgcaccgcaacatggtcgcaaacgtgctgcaagccaaaggcgcttacggccctgtgctgcaagagggtcgcgagctggtggtcaccgcactgccgctgtaccacgtgtttgccttaaccgtaaactgcttgctgtttattgaaatgggtggccgcaacttattgatcactaacccgcgtgatataccgggctttgtgaaagagctgcaaaagtacccatttacagccattaccggtgtaaacaccctgtttaatgcgctggtgaataacgaagatttccacgagctcgacttcaaaaatatgaagctagcagttggtggtggtatggcggtacaacgcgctgttgccgagcgttggaaaaagactaccggtgtccatttgctcgaaggctatggtttgaccgagtgttcgccactggtgaccggcaacccatacgatttgacggattacacgggtgcgattggtttaccagtaccgtcaaccgaagtgcggattgtggatgatgcgggtaatgtggtgcctaacgatcaagttggtgagctgcaagtgcgtggtccacaagtcatgcaaggttactggcagcgtcctgaagcgaccaaagaagtgctcaatgctgagggatggctttcaactggcgatattgtgaaattcgatgatcaaggtttgatccacattgttgatcgtaagaaagacatgattctggtttcaggctttaacgtttatccgaatgaaatcgaagatgtggtggcgctgcacggcaaagtgctagaagtcgcagcgattggtcaggctaacgatgtttctggcgaattggtgaagatttatgtggtgaagcgcgacccaagcttgaccaaagacgaagtgattgctcactgtcgtaagcatctgactggctacaaagtgccaaaactggttgaatttcgtgacgacctgccaaaaaccaacgtgggcaaaatcctgcgtcgtgtgctgcgtgaagaaaatgacgcacagttggcagcaaaggcgaagcaaagcgcataagctgtacccagctgcgagtgttttttaatgttagaatgccggccttagctgccggcattttctttcaaaagaagtctctcttcttttgagcaacaactgcgagttatctgtgaattatcaaattattagccaagtaggcgatctacaacgagtctgtcttgctgcccgtgatgcggatgtggtgatgctggataccgaatttgtccgtacccgcaccttctttccgcaactggggttgatccagatgtttgatggggaaaacctatcgctgattgatcccaccgtgctggatgaaatgacgccgtttgtcgagttattgcaagacacttcggtattgaaagtgctgcacgcctgtggcgaagatttggaagtgttccagaatgcgtttggctgcacgcctttccctatggtggatactcagattatggccgcgtttttgggctacggtttatccactgggtttgcggcgttagtgcaagaccaactgcaagttgagctagacaaaagcgaatcgcgcaccgattggttagcgcgccctctaagtgacaagcaactggaatatgccgcggccgatgtgttctatctgctaccgatgtacgaaaaactggtcgagcaagtgacccaagccggctggtgggacgcggcattgcaagaaagtgaactgcaagtggccaagcgcactaaagtcagcaacccagagctcgcttacttagacatcaaaggggcttggcagcttaaacctaaagagctggcgatcctcaaacccctagcaacatggcgttaccatgaagcggtaaatcgagatttggcgctgaacttcgtgattaaagaaacggacttactgaccatttcgcgtttggcacttcgtagtccgaaacgcatggaagaggagggggttgatccgcacgcaatccgtcgtcacagcagcaaaattatcgctatggtgaaaacggcgctagaaacgccagccgatgcgtatccaccagaaatcgtgccgatcatggaatacccaggttataagcagttgttcaaacgtttgaaagatgaagtaaagagcgtttcgaacaccagtggccttgcgaccgaatttttggcgtcgaaaaaacagcttaaccaactgctgagttgggtatggaagcgcgaccgcgacccagcccgcttgcctgatttaatgcaagggtggcgtttaccattacttggcgagaagctcaatacgctcgtcttgaaataatctccttccgacttggatctgcagcgccaagtcgtttcaggataggtgttttattcacgcatttttctgtcagtaaaattccatgaacagtaggcactatcgcatttctcggagtgcctactcgcatcgcgcagcatcgtgcgataatgcgccttcatcgactcttctaatctaggcaagaagagcaaggaaaatcatcaataaggattgttatgtctgcgacacattacctcaatcaacttaaccaccgttatctgaacatccatcgtgtcaaagaagatttcttctgggatacctacatggggctgagttatgatcatgtgggttccgcgcaagcacaaaccgagtggactcagtttctgagcaatggtgcgcggattgaggaaattcgccagcaaatcgaattggcagaacagatcaccgatagcgaagaaaaagcgcaaaccttaacgggcttacaaggctggctcgcgatgtttgaaagtcatgcgctggaatcagagcaagcgcagtcactcaaagccggattaatccaatttgaggccgatctgtttgagaaaaaacagaagcatgtgctgacttataccaacgaacagggcgaagcggtagaagcctcgattgtcactttaggttccacggtgcgtactcatgatcaagaagcagtacgtcgcagcgcccatcaggctttcttaggcttagaacagtggttattacaaaatggattgttagagctggtgaagcgtcgtaaccattttgcgcgcagcttaggttataaaaccttttttgattactcggttgccaaaaaagagaagatgaccactgagcaactgttcaccattttggatgattttgaacagcgcacgcgtgatcgtcacttcactagcttagcggaacttgcacaaagtaaaggtgagcaagcgctgcaaggacataacttcatctattcgtttgcgggcgatgtgatgcgtgagctggacccttacgtgccattttcacaatcgctgcgtcgttgggtggagtcttttggtcgcctcaatattgaatttagtggcgctgagctgacccttgatttgctggatcgtaaaggtaaatatccaaacggtttctgccatgggccaattccggcgttttacgaccaaggtcagtgggtcgcggcgaaagttaatttcaccagtaatgctaagccagatcaggtaggcagtggttacgatggcatcaacaccttgttccatgaaggtgggcacgcggcgcactttgcgaatgtgaagatgaacgcgccgtgtttttcacaagaatttgcacccacttcgatggcgtacgctgaaacgcaatccatgttttgcgatagtctattgatggatgctgactggttgaaaacctatgccaaagatgtacaaggtaacccagtgccagatgagctcatcaaagccatggtatttagccgccaaccgtttaaagcttacgaagagcgcagtattttgctcgtgccgtattttgagcgagcactgtatgaactgagcgaggaagagctgactgcagagcgcgtcactgaactggccagagccactgaaaagcggattatcggccttgaatgcagtccgcgtccgctgatggcgatcccgcatctgttatccgatgaatcggcgtgtgcttatcacggttacttgttggcgcacatggcggtgtaccaaactcgcgcttatttccttgggcagtttggttatttcaccgataacccagcgattgggccactactggcgaagcattattggcagcaaggcaatgcactttctcacaatgacactattgtgaacctcactggtgaaggctttaatgctcgctatcttgccgatgcctgtaacttaactccggatgaagcatggcaaaagcagcagcacaaaatggcgcaattggcgacgcgtgagcaaaccaaacccgcttcattaaatgcgcagattcgagtgattgatggcgccactgagctggcttctaaccgtgattcggatgaagagatgtgccgccaatttgaggcgtacattgccaaacattacggttgctaattaggctgttaatgaaacacacgtactgaaaaataaaaaggctgaacgcatagcgttcggccttttttatcctgtttattgcgatagtttacgctgcaagaagcaatgcccagcagcaagcaacaaaccgccgactaaaccggccaaatgggcttccgtcgctactcgtgcgccaatcagctctgcggtgctagcggatgcgccaaaccactgctcccatgcgacttttccgataacgccaagcactaacagccaactgctgcgtcgtccattcagtgcttcattcagcgcgtagtaagcaaacagaccatgcaaggtgccggagagcccaacataagactgcatgtcggaggcgagaatcatcactcccaccgcaaggctgatcagtagcagagggatcagaagctgacgagccgtgggtttaaacacaaagctgatgatccataatgcggcaaggttcatcgcccagtgggcaaagttggtgtgtgcgaagtttcctgttaggatgcgccaccattgaccttgttctatggcgctgaagtgccacagagtcagctcatgcagtggtggccactgcagacttaaactcaacaggcttattgccaataacagcaggtaaagattcacgtcatgtcccgttattgttccgagtgtggtaaagcgcgtaaagcgtgcttgtgtccgtccattgtcgcgctggaaagtgcggttgagcttatcattcttcagcacccaacggaacaaaagcgcccactcggtaccgcgcgcattctcagcttgtcattggccaattgtcggctattggtgggcgaagattttcgtgagcatgacgagttaaaccaactgctggcagagccggatgtggactactatgtgctttatccgaatgaacacgcgcaagagtgcacaaagataagcctcacgacagcgcgcaaaacgcgggtgattttgctcgatgggacgtggaaaaaagcctacaagatgtggcaaatcaacactcaactgcatgacttaccgagcctacatttgccggacgagtgtgttgggcattaccgaattcgtaaagcgccggatgatacagcgctttccacagtggaggcgggttatcatctgctccagcagtggcaacctgagcgtgacttctcgccactgctcaaggtgtttgatgccatgattcaatatcagatcgatcagatgccggaaggcgttttcgagcgaaattaccgtcagtaatgactctgcgctgagaagagctgctgatgcagtcgctgcgcgtaagcatcggtcatcgcggcaatgtaatcgcagatcacgcgcatgccttcgtcttgttcttgggctttacgccacttttcgccggtggcttgtggcagtagacgttctgggtcagcacttaacgcttcaaacaaatccatgatcagttgctggcctttgtattcaaagcgctgtacctgcggaatttgaatcacgtattggctcacaaagtgtttgagcacttcaagcgcattgcccatgtgcggctcgatataagcattgaacgccaacagttcattatgaaatggcgcttcaactggcttcacgctgatactggttaaaagggcatttacaatgccgccaatcgcatctttgcgcacatagtgtttaccagaaaacagcatctcactgagctcggcaatatgttcttcaaaccaaggatcgccgcactcggcaagctgcgccgctgcggcttcttgccactgcgcgcgggttaccatacccagcacaatcgcatcttccagatcatgcacgccgtaagcgatgtcatccgccagttccatgatcgagcaatcgagcgatttaaagcgagttttacggtgctctttgggggagcttggttctgcgcgcatttgtcccaacaattcacgatcactttcacacagcggctccagcacccagtccaagctcgcgagatcacaatcgtagatgccttttgcaggcgaccaatctttagctttcagttggcgttggtgggcgaccgctggcggtggtattgcagcgcgcgtggcactcagcagcgcagggtatttcaaaagcccgagtagcgtgcggcgcgacaggttcatgccgtgatgctcagtgtaaggctctaagctggtgacgatccgaaaagtctgcgcattgccttcaaagccaccgtgatcgcgcatcatataattgagcgcaatttcaccgccatgcccgtaagggggatgaccaatatcgtgcgcaaggcagagtgaatcaattaggctatcagaaggtaatagctcacgaaactccggttgtttgagtttaatttgcgcgacgatgccggtaccgatttgcgctgcttccagtgaatgggtgaggcgagtgcgatgaaagtcattcaagcttgttccgtggacttgggttttggcttgcaagcgccgaaaagccgccgaatggaggatacgcgcgcgatcgcgctgaaatgggctgcgatgatcgttgcggcgaattttgtgctcatcgttgttacgagctaaccactcagggtttagggatacttgcatcgcgttactccttgcacagttttgttttaacttacaatgtcttaagttatagcgacttagctgatttcgtccagtgttaattcaaaactcggggcaaaggtttgtagaaaatacgccatctcctcactgtgccgttcacgcaacgtcacatcgaggcgttttttcgcttgagcgtattcgtggttacctgcgctgagctcttccaaacatttcaaatacgcgcaaatcgcatcggcttgcttaacgatggcgctttcatcgggatcggccgtattggagataagaaacgggcgaaaatcgtcgcgcagttcttctgggagcatatccaataaacgccgctcggccgccgcttcgatttttttgtactctttagcgatctcgggattgaaatacttgatgggcgttggcaaatcaccggtcagcacttcactggtatcgtgatacatggcaagcagcgcaatgcgctcagggttgagcgttccaccaaattttttgtttttgatcaccgccagtgcatgagcgacaaaggcgacttgcaggctgtgctcagaaatattttcactggagatggaacgcattaatggccagcgctgaatcagtttcatgcgcgcgaggtgggcgaaaaaatggctctcttgcatagcactctcacttccttgctgatggattggcttttcaacggccgatgacgctgaaaagaagataaaaaaacaggctctcttcagtgtaccgaaagagagcctgcttcgcctacccacgacagcaagtcattttgcgacttgctgccaatctattattggctgtaagtcgtgataaagcgttcaaagcgactgatggcgatttccagatcttccacatgaggcagagtcacaatgcggaagtgatccggttttggccagttaaagccgctgccttgtactagcagcactttttcttgcactaggaaatcaagcaccattttctggtcatctttgatcggatacattttggtatcaattttcgggaacaggtacatcgcgccttttggcttcacgcaagaaatccccgggatctggttaatcagctcccatgcgcgatcacgctgttccagcagtcggccgcccggcaaaatcagctcattgatactttgatagccgccgagtgcggtttgaatggcatgttgcattggcacgttggcacacaagcgcatcgaggccagcatatcgagccctgcaatatagccttgtgcttgctgtttggggccagtcaggaacatccagccaccacggaaaccacaaacacggtaagctttggataagccgttgaaggtgacgactaatacatcatccgctaaggtggcgattgaggtatgcaccgcgccgtcgtacagcactttgtcgtaaatctcatcggcgaaaatcatcagcttgtgcttgcgagcaatctcgatgatttccagcaagaaatcacgactgtaaaccgcaccggttgggttattggggttgatcagcacaatgccacgggttttcggggtgattttgctgcgaatatcgtcgaggtcaggataccaatcggcttcttcatcacagatgtagtgcacggctttgccgccagaaagtgctaccgcggctgtccacagtgggtaatcaggggcaggtaccagcatttcatcgccattgttgagcagggcttgcatcgccatcacgataagctctgatgcaccgttgccgatgtacacatcttcgacgtccagactgcggataccttttttctggtagtactgcaccaccgctttacgagcggaataaatgcctttcgagtcacagtaaccttgtgaagtaggtaggttacggatcacatcgactaggatctcgtctggggcgtcgaaaccaaacggggcagggttaccgatgttaagcttcagtattttatgcccttcttcttccatgcgtttagcatgtttaagcactggtcctcgaatgtcatagcagacattatcgagttttgacgacatcccgatattttgcattgtaatattcctgaaaataatctgttttcttgatcaaactacactaacttgccattttttagaataaaaatctaagacaacctggttttaaaatcagaagacatgttgcctcgatcacttgccgaagtaaaagataccccataaccttgatttcataaggctctctcaatagagtagccgcagtttaccgaatctctccccgtacgaggtcgctttgttgcatttttatcaggccgttgctcaattgatggagcacatccgtggcgcgaaggctcatgatgttcgttttactcagccgttggccgataagcctccctttgcgctgattgactggcttgatgcccaaccgattttccccaaattttactggcaatcgcgtgatactcgtgaagaagtggtcgcgctcggtcaggtgtacacgtttaccgatcctgctccggcgtatgcgattttaggcgatgagcagcgagtatggggtggacgctcctttgatgggcataccgccaaaaatccgcgttgtatgtcttccttcttctttctaccacagattgaactgattcgacgggatgaacagtggttactcgcggtcaatatcaacaatgagccgcagcgcacgctgaccgcactgcaaaaactgctggtggaagtgcccactttgcgttcgatgacagcgcacgtcactcgtgtcgaacacacgccaacggcggctaactggcatgatttggtggaaaaagtgctggcggggatcaccgaaaaacagtttaaaaaagtggtgttagcgcgtaaaacaacgctgacattggatgcaccgctcagtgcggcgcaactgctcaaagctagccatgcccaaaatcaccacagctttcactttcttttggctctcgattctcgccacagctttatggggtcaaccccagagcggctctacctacgccatgggcagaatctggaaaccgaagctttagcgggcacgattggtcggggagctaatgcgacgcaagatatggaactggctcactggctgacgcatgacagtaaaaacctcaatgaaaatcagttggtggtagaggacatcatcgaaagcctcgcgccgcacgccgagcagatccatacccagcgagaagcgcagctggtgcgattgcgtaaagtgcagcatctgaaaaaacgcattgatgcgcagcttaaatctggggtcaatggcgtgcagttactgggcgtattacaacctaccgccgcggttgcgggtttacctcgtcaagcggcactggctttcatcgcggaaaatgagccttttgcacgcggctggtacgcaggctccatgggttactttagccatgcgcaagccgagttttgtgtggcgatccgcagtgctttagtggtggataaacaagttcagctctatgcaggcgctggcattgtgccgggctcgattgctgagcatgaatggcaggagctggataaaaagctctctaccttattgagcttgataaccgaccgcttaccgctgggagtggcatcatgaaccgcgatcaagctttattgaaccgtctttggtcgcgagtgttactcgaagagttaagccgtttgggagtgacacaagtgtgtgtggctccgggctctcgttcaaccccgttgacgcttgaggctaatgcgaatacggctttcacgttacatactcactatgacgagcgcggcttagggtttatggcgcttggtttagcgaaagctagccaacagcctgtcgcggtgattgtaacctcgggcactgcagtggcgaacttattaccagccattgctgaatccaaactcaccggtgaacgtttagtggtactcacggcggatcgtccgcttgagctagtggggtgtggtgccaatcaagccattgtgcaatcggggattttttcatctcatgtcacggcatcgctggagctgcctagtcctgccatccatcatccactttcttggctactcacgtcgattgatgaagtgatggcgcgtcaagccctactcggtggcagtgtacacatcaattgcccatttcctgagcccttgtattcggctggggatgaggcgatttatcaaccctatttacaacctgttcagcgttggcgtgagcaagctcggccttatacccaagttcatcaaggattagtgcagagtgttcccgctgcaatcgatggcttgctgactaaaggggtggtgatagttggctcgctgagcttgcaagaggctcaagcggcaaagcgttttgccaaagcgatgggctggccgttactgtgcgatccacaatcgggcatcagtagccaatgggcacattttgatctctggctgcagcatcccaaagcacgtgaacagctcaatcaagctcaatgtgtggtgcaatttggttcgcggattgtctccaaacgtctgttgcagtggttagaagcgtggtgcgccacgggtcttggcgagtatcattacattgcgccgcacagcgcacgcaataacccttggcacgccatgcagcagcagtgggtgtgtgagattagccactgggtagacgctgtgctcagcaaacgcttagcgggtcaacatacccagcaaggttgggccgatgagttaacccattatgcgcagtcggttcgccaactggcgcaactgcatttctcctcttcttccctgagtgaagtcgcactggcgctagatttgacggagcgcgctacgcaagcggatctgtttttgggcaacagcctgattgtgcgtttggtggatatattcagcgcgcttgatgggcgtgaagtgttctccaatcgtggcgcatctggcattgatggcttagtcgccacagcgtcaggggtgcaacgtgcgcggcaaaagccattactgatgctgctgggagatacctcgctactgtacgatctcaactcgctcgcgttgatgcgcaatcctgcgcagccgaccgtgatagtcgtgaccaataacgacggcggagcgattttcgatctcctgcctgtgccgagtgagcagcgcgaagcgctctatcaaatgccgcatggaatggactttgctcacgccgcatcacaatttggtttagcgtattgtgcggcgcaaaccttagagcactaccaaaccttggtggaagagcattttgcacacggtgcaggtactttgcttatcgaggtgaaaaccccgccgcagcaagcttccatgcacatcaaacaactgacatcgcaactccatgctctctaaccaactgcactttgccaagcctactgcgcgaacacccttggtggtgttggtgcacggtttgcttggcagtggtgcggattggcaaccggttctctctcatttagcgcgcactcagtgcgcagcattgacgctggatcttcccggccacggcacaaatccagaacggcattgtgataattttgccgaagcggtcgaaatgatcgagcaaaccgtacaagcccatgttacttctgaggtgccagtcattttggttggctattcgctcggcgggcgattaatcatgcatggattagcgcagggggctttttcgcgtcttaatctgcgaggggcgatcatcgaaggtggtcacttcgggctgcaagagaatgaggaaaaagcagcgcgttggcaacatgatcagcagtgggcgcagcgctttagtcagcaaccgattgagcatgtgttgagcgattggtatcaacaagcggtatttagttcactaaatcatgagcaaagacaaactttgattgcgcaacgtagtgctaatcttggttcatcagtagcacatatgttactggcaacaagtctggctaagcagccctatttattgccagcgctgcaggctcttaagctccccatccattacgtgtgtggtgagcaagacagtaaatttcagcaactcgccgagagtagcgggttaagttacagtcaggttgcgcaggcgggacacaatgtccaccacgaacagccgcaagcgtttgccaagattgtacaagcgatgatccactcaataatcgattgagtgataacgacaatgggaaccaccatggctaaaactacaggcatttctgagcaagaactctacgcaccagtgatttggcaagactgcaccggtgactatcaagatatccactaccacaaatccgacgatgggattgccaaaatcaccatcgccagaccacaagtacgcaatgcgtttcgtccattgaccgtcaaagagatgatccatgcactggcggatgcgcgttatgacgacaaagtgggtgtgattatcctgaccggtttaggtgaagatgccttctgctccggtggcgatcagaaaattcgtggtgactacggcggttaccgcgatgattccggtactcaccacctgaacgtgctcgatttccaacgccagatccgtacttgtccaaagccagtgattgcggctgtggctggttgggcggtgggcggcggtcatgtactgcacatgatgtgtgacctgaccatcgcagcagaaaatgcacaatttggtcaaacgggcccgaaagtcggctcattcgatggcggctggggagcttcttacatggcgcgtattgtcggccagaagaaagcgcgcgaaatttggttcctatgccgcttctacaatgcccaagaagccttggacatggggctggtgaacacggttgtgccagtggaagagctggaaagagaaaccgtgcgctggtgtcgtgaagtgctgcaacacagcccaatggcgattcgctgcttgaaagcggcactgaatgcggactgtgatggtcaagcaggactgcaagagctggctggcaacgcgaccatgctgttctacatgactgaagaaggtcaggaaggccgtaacgcgtttaatgaaaaacgccgcccggacttcaacaagttcccgcgtaacccataattcttctcagagcggcgtcctgccgctctttctctttgagcataaaccccgtttatgtggatgtattggatataggaagagatcagcatgcgtcatgcaaccctctatcgctaccaactgccgatggatagcggtgtcatccttcgcaatgagaaactgactcagcgtgaaggctttattgtcgaactgaccgaaaacggccgtactgcacgcggcgagattgcaccgctgcccggctttagccgtgaaacgctggaagacgccggcttacaagcgcaagcgctgcttgagcagtgggtcaaaggtcacgctatcgagtgggatgcacagcatccttcggtcgcttttggtctttcgatggcacattacgagctagaacaagcgctgcccgagcaaggcaactactatgttgcgccgctgtgtacgggcgatcctgatgagctgctgccggtgttgaacaacttaccggggcagaaagtcgctaaagttaaagttgggctgtatgaaccgattcgggatggcatgctcgtcaatctattcttggaatcgatgccggatttaacgctgcgtttggatgccaaccgcgcgtggactccagccaaagcgctcaagttcgctcaatacgttgcgccgtctttgcgtagccgaattgcgtttttggaagagccgtgccagtcgccaagcgaaagcatcgcattttcgattgataccgggattgcgattgcgtgggacgaaaccttacaagaagcggttcgcgatgcggattttgctttagagaatctgttaggtgtcaaaaccattgtcatcaaaccaaccctaattggctcggtgtatcgtgtagaggctttgatcgagaaagccaaaacacttgggctacaagcggtgatcagctctagcttagagtcgagcttgggcttgaaccagttagcacgtttagcgcataaactgctgcctaatgaagtgccgggactggatacgattgggttattccgagctcagctcgaaacgccttggccaaatagctcactgcctgtggttgccctgcaagagcagtcaatcgtatggcgctcggaatcttccctgtgagcctttggcagccttggcttgagcgtgaccccaagcaggttgcgctgagtcatgctgggcaaaccctgacttggcaagtattagatagccaagtagcgcactacgctaaagcgctgcgtgagcaaggggttcggtcgggggaagtggtgacgctggtcgggaaaaatcatctgcacactgtgctgtggtttttggcttgtactcaagtgggcgcgctgtgcgcctttcttgcgcctcaacctttagctcgtttgcaggaaaagctcgccacactctatgccgagcaaagcccgaagcacctttggctagcgccttcttgcgcgctgagtgaagaagatattacggcgcttaatgcccatcgcctgagtttgcccgatgagcgggatgaatccgttggtggcgagaaagtctctagccagttttctggtgaacaactggcgacattaattttcacttcaggttcgacggggacacctaaagcggtggcacacacccatcagcaacatttggtttcggcgcgcggtttactgaacaagtttgcttttaccgaatcagacagttggttgctgagcttgccgctgtatcatatctctggtgtcgctattctctatcgctggcttgctgtcggagccacactcaagatcggcactggcgatctgcaaaacgatattgctggcgtcactcacgcttcattggtgcctactcagcttaaacgtctgttggacagcagctctccattgacgctcaaacgtgttctgctcggcgggagccatatccccgttgaactcgctcaaatggcggcaacgcgcggtattgatacttggctcggctatggcatgaccgaagccgcctccaccgtgacggcaaagcgggtcgatggacttgcaggtaatggtgagcttttggagcatcgtgagctgcgccttgttgatgggcggattttcattgctgggaagacgttggcacaaggctattatcggcaagggcagctagtgccgctcactaatgagcagggttggtttgacagcaaagatctcggtcgctggcagggcaataacctgttgattgatggccgagcggataatctttttatctctggcggtgaaaatgttcactgtgaagaaatagaagcggtgttaaaccagcaccctcatgtgcaagtggcgatcgtaatacccgttcaagatagtgagtttggtgcgcgacccgtcgccgtgattcgtagtgaggccgagtggtgtcaagccatcggtgatacttggtgccaaggtaaactcgaaaaattcaaatggcctatcatgtactgtttactccccgatgctttgctggatgggggaattaaagtctctcgtgcggcggtgaaagcgtggttggccgccaaccaaacgcagttcactccgctataagattaaacctatccgctgctgggtgagtttatggtcgcgggcgagtcgtcaaccgtaagtacgccaatccgatcacaaggccaatcagcgtcgcgctcattccaaacaaggtggcaccagaaagcgtgatcacaaaagtgagtagcgcaggctcgcggtactcatcgattttaaacgcgctctgcaaacacatcatcaatgtaccgagcagcgctaaaccagcgagcatggctgaaataggtttgggtagcgcgaggaagagattgacgacaagggccgcaaaaatccctgccaataaataaaatcctccagcccaaagtaccgcacggtagcgttgtgctttgtcttgatcgacatcctcattcatacagatggcggcagaaatggcggctaagttgacgctaaagccgccaaaaggcgcgctcatcagggtcgccaatcccgtgcccaccaaaatcggtttgattggtgcgtcatactgatagcttttgagcatcgcaatacccggtaaattttgtgaaagcatggtgatgaggtagagtggcagggcaaggttgagtatggcgagccaatcaaactccggcattacccagattggcgtggcgatccgcagcgccagatccgcatgctgaaagcttcccaaggcgagagcactgccaagactgaccagcaagagcaccaacatggtgtatcgaggaacaaggtgcttagccagtaagtagctagtaaataaaagcgcaaagagtgcgggagtatcggtcagcggggtgaaggctttggcacaaaagggcagcaaaatagcaccaagcatagccgtacctagaggaactgggattttactcagtgctcgtgtcaaaggtgcgagcatgcccgtcaaagtaaacagtgcgccagagaacataaacgcgccaatcaccacgggtaatgaatattgtcccgccgatgccgccagcatgactgccgcaggtgttgaccacgccgtgacaattggcgttttgtaaaaccaagagtagaggattgacgttagccccatcaccacgcctagagtcagcaaccaactttcgatttgagttggattggcacctgaggctgtggcggcttggatcacgatcaccaccgaactggtgtatcccaccaaaaccgtggtaaatcccgcagagaggtgactaagattgaagaatcctttcatcatgatttccttttcaggtaaagtcgtgcgtaatagcgcacgttccgagtatagctctgtgcgttatagcgcacaataaggggttttcgcatgactgacgtgatgtttaagtcacaaattgctaatcaattaaaaaatctgcgcaaaagcagagggttgagtttggatgccactgctcaacttactggggtatctaaagccatgttaggtcaaattgaacgtggtgaatccagtcccaccattgcgacactttggaaaattgctagcggccttgaggcttcattttccgctttctttgccaatgatccgcaacttttgtcgagtgagcgttctttccctgacgatctcaacatgaaaatccacaccttatttccttatgccgcagatacaggattggaaatatttgaaattacactgctcgatcaccatcagcagatgtcatcacctcatgctttaggggtcattgaatacattcatgttttggaagggattatgaaggtgttctttgatgaacagtggcatgagttgcaacagggagagcatattcgtttttttagcgaccaacctcacgggtatgcggcggtgacagaaaaagcagtgtttcaaaatattgttgcgtacccaaggcgcggctaacaggtgcagtgggcggttttggcataggtaagtcacccactgccagaggatactaaattttgaatttactcatctttagcgccaaatcttcttgttttagcttgagtgctgaaatggtgtgctcactctgttggattttttcttgggcactttggcaaagtgcttgtaagtgagaaaggctagaagcaatactggtcaccgattgctcttgatgagtaatcgcctcagaggtctgctggttcatctgcgttagtcgagagatttcaatcgcgacttgatgtaaggactcttcagcctgtgatgtgatctctgtggtttgagtaccttttaacatgctgttgttaataactcttaccgattcatcggcgctgctacgcaattgagtaatgctctgctggatggtgttggtactgccttgtgttcgtgtagcaagtgaacgcacttcatcggcaaccaccgcaaagcctcgcccttgttctcccgcacgagcggcttcaatcgctgcattaagtgcgagcaaattagtttgttctgcaatgccattaatgtcggctaaaactggctcgatacttgtgacatgattttttaaggagttgatggtttcagttccttgtgtcacctctgcaaccagttcattgaccgattgagcggcttgtcgaacgttgctgagtgtactttgcgcgtttttatctatgttaagtaccgattggcttatctctcgcgcgccactgatcacttgcgaagaaatggcggtcatcgccgtggtcgcgttcgaaatagtattcacttcgaatgtctgtttattgacggcttctgcggtcactttaaacgtggcagacaggtctaccgccgcggtcttagcgagattggtagattgagtgatgtcagcaataagattctgtattttttcgataaatttatcgaatgatttgcccaattctccaaactcatcttgggtggtgatgttcactcgcagggttaagtcaccattaccttcagagatatcggttactctctcctgcaaacgttgtataggcgatagaatttggttcacaaggatccaacctaacaacagtaatacaagcaaagcgataatgatcaataccttaaatgaagatatcgcccatgcttgtccatctaaaataagcacggcttgctgctctactttactgtctgcgagttcttctaattcggcaatgaaatccagtaatgccagtgatgttactgtgtactcttggtagatttgacgatagttccgatagctttcaatgaccgccatcatcgcctgttcatgctgcgagtttaattgggagaatacttcttcataacttgcatttttccattcctctcctgccgatatagtaaatcggccagtcgagaacatttcgctgttggcttgtttttgaaatccaatcgcttgttcaatggctttaatttgagtggcatcatcttgaccatccagcaaacgttgtgtgtagtagagcttccatagcaagcctatattggattccataccgccatctgcggcttgccagcgttccataacatcactttgccaagtgatgttccgattaggttctcgttctaattcctcaacggcactatcacctaatgtctctagtttttcaccaaaatcgacaaggacttgcgttgctttatcgtaggattttttggtctcgatatagttcttgtagctagtaatcagtgtgtttcttgattgttgatactgtgagttgaattgagaaaattgttgtgtctgagccgcacttaatagacccgcttcgatcatgcgggaagaggacgtatcgacatctgtaatggcagtattgagtatttgttcaacccgttggctatcttcgcctaggatgagcctattgacggcaagcatctgagcttcaatctgtatggtggtttccatcgccccatctgccgtatcccaagcggggccaacaatgtagctcaaccccgaggagcttgagtacatggtttttattgtccaaatgcctaaagcagtaactaaaatacctacgacgctgaatgtgactaatatttttgtttttactctcatgaaagagtcctctaacccatcatatttaccggatgacactgttggtgctaaacgaaaggctgaaaaagtcggtaatgtgactttgagtctagaacagttttggtgatgttattggttaattgggaggataaataatggggttatgaggagaagttgcagcgcgattgactgcaacttcaaaacatcatgaataatagaggaagaaggtgtgggattaacgccaatcgccacgcaattgtgccactttttcgtgcatcaccgccgagttggcttgctccggggcaactggcattcccgcttcaatctctaactgtgagcgaaaacggcgtggcacaccttggcaagctcggcctttgtaacggctgaaataactgccccataaccctttgagtgccagaggaaccacaggaacagggctgcggtgtaggattaaatctaagccacgcataaacggattcatttcaccatcggcggtaagtcgaccttctgggaaaatgcacaccaaattcccttcgttgagtgagtgttcaatatccgcaaatgcgcggcgaagagaggctcggttgttggcagaaatcgggatcaccccagcgcgtttcaagaaacgtttcagcagtggcaggttggcgtactcttcttccatcacaaagtgaattaagcgcggacaaaccgcactgagcaatagggcatccatataactgacatggttacacaccagcagtgcgccaccttgctctggaatatggtgcaagtttttatggcgcactcggtacagcgtatgagtgaggatccacaccagaaagcgaacggcaaaaatcggcacttgtaggaaaatatacaaagccaccaagacgttaagcacagccagtagtgcaaataactgcggaatactcatctccaatacactgaggcacacaatgccaagtgcggcactgccgaccataaacagcgaattgtagatattgagagccgcgatcacttgcgcacgttcagtgactttagcgcgttgctgcaacatggcgtaaagcggaacgatgaatacgccaccaaacacgccaatcaataataaataagcaaatagtggccatagcgcggagtaagtaacaaaatccgcaaaagtactgaaaatggggagatcggcgggaatgctggtcgccatcagatacccgaagaagctgatccccacactgcccaagggcacaatgccgacctcaatccggtgtccggaaagcttgtcacacgccagtgagccgacggcaatgccgacggaaaatagcgccagtaagaaagagaccgcggcttcattaccgttgaggtgcagtttagtgaagttaggaaactgagtaaggtaccccgcgccgagaaaccagaaccaactgatcgccataatggactggaaaatggcgcgatcacgtttggctatgcggagcgtctgcttggtttgcgtaattggctgccaacgaaattcgagatgaggagcactcgcaggtgcgagtgggatagcgcggctagagagataaccaagcacggcgaaaatcactaccgcagccgcggcgaagtagtgcgcgttatcagcggaagcaatcagtccagcccctaaggtgcctaataagatcgccagaaaagtaccggtttctactaaggcattaccggggacgagctcttccgatttcagttgttgtggtagcaatgcgtatttcactgggccaaaaaaggccgattgtgtacccatcaagaacaataaaaacagtgagattccgtagctttgagtgataaaacctatcgcaccacacagcatgatggcgatttcaagcaatttaacccaacgaatataccgagacttttctagcttatccgctaagactcccgcggtcgcagagaagaggaaaaaaggcagaataaacagcccagcagcgagattgatgaataaattgcttgagataggtaacgcttgagggcctgcaaacgcaacaaagagtaacaagacatttttaaaaatgttgtcgttaaaggcaccaagaaactgagtgatgaaatagggtaaaaagcggcgctcagttaagagagccgtagttgggtttgccatcttgttcatccattaccagttagccagatagtgattcagcagattattaatcaaagcattaccatcaatcggttcattggcaaaaaatttatcatcgacactcaagatagtgatgccatgcacgccagaccacaatacgcggctcgcctgcaacacttcttgctctgaacgcaaaggcgcaatcactttcagcagatcttctaacatgctggtcatgttattaatgcgttgagcttgccactcgggcagcatctccccattcatattgtgttcaaaaattaactgccagcgataaggatttcttttcgcaaaatcatggtagcaataagccagttgatagagtgcatctttcggataagtggtggatttcacagcttgctgggcttcttgcgccaattcatcaagggtttgcgccactacatgcaatagcaacaaattgtaattgccaaacacgttgactaaggtgctgggcacgtagccaatcatagtggcgactttacgtaagctcagctcatgataggagtgagtatcgaggaactgtttgactctatctaaggtgagagccaccagctcttctcgggtatgatcgtttcgtctagccatgatctggattcaataatgaacaacgttcgatagtctaaacatcccctataggagcgtcaacgaatcgatttgcaatattctgatacatgtcgataaatgcaaaacgtttccattgcgagatgaactggctatagtgactttgagaagatagatcggctgcaaagccccataacatcgaaccctaaggaagtgtatgaaacgtttgttttcgcttatcgcgttaatcatggtttcggttgcggtaactccgattgctgaggccaaaaaattcggaggtggtaagtcgtttggtaataacagttacaaaacggctccggcacctaaacagcaacaacaaaaaaatgacaccgtgaaaaatgatgcggcgaatccagccagctctgcgaagaaaggcttaatgggcggtttgctcggcggtctactggcaggtggtctgcttgctgccttctttggcggtgcatttgaaggtatccaatttatggatatcctgatcatgggtctgattgcgtttgtgatcttcaagctgatgcgtgcttttctggcatcgaagcaaggcagcataaaccaatctcagcagcaaccggcctacagcggcatgaaccgtacgccgtttgagcaacctaatgtacacaactttgaacagccacaatctatgggtggtggttttggtagtgccgctcagagcgatgtaccccacaattacccagccggttttgaccgcgtggcgtttgtgaatggtgcacgtgaacactatcgcatcttgcaaggggcgtggaaccataaccaactcgaaacgattcgtgagtatgtctctccaagcttgtttgaagatcttaaagccgagcgtgcgaattacgaaggcgatcaacatacggacgtcatgtacgtggatgcagagattgttcgtgcagactacgatgcaaaccgcgctcagctcagcttgcagttcagcggtcgttatcgtgacgctgtcgaaggtattgaagaaaacatcgaggacgtatggcacttagaacgtgatctgacagtccccaatgctccttggttgattgttggtatccaaggttaaaaaacagaccaacgcccaatttagtcattgtattcaacacccagcgaaagctgggtgttttttatcacgaaaatccgaagcctgcctcaactgcaatctgccgatttttgggtatatactggtcgccttcaatatggcacaaaaggaaagtgacgtggcgcaattcaaacatcaacaactcagccaagccgagcaagataaactcgatgccgcagtgtttcgtcaactgctacaacatcttgatcaacataaagaagttcagaacatcgacctgatgattttggcggatttttgccgcaactgcttgtgtaaatggtacgctgctgaagcggaaaaacaggggttggatttgaatattgatgatgcgcgtgagcgcgtttacggtatgacttacgatgagtggaaggcaaaccaccagccgcctgcgacgccagagcaactcgccgcctttgaagcgaaaacgaaaagcaaagcttaaatgtaggcaataaaaaacgcgcccaatggatggcgcgtttttcgtaaaccgtataagcggctcggtttattgcttgcttagcacgtaaaactcagccagctcaccttcgataaccttaccttccatatccagatgggacagcgtgttttcacccaccatgaattgtctgccagtttggtcgcctgtttgcagtgttacgatgttgccagcttcattccaaacgaaagtaccttgagaggcaaaaggttcaccttctttatcgaggtatttttctgttagcgcgtaggtgccatccgcgttcagcgtcagctctgtttcaatgccaccgcaatcagcacaaggcagagtgccttgatagatgccagcccaatctaggctgttttgagcattgtgcgctgcatcaacgcttgctgttgatggttgagccgcagattgctcagcaggtgctgccgcaacatcaacgactttttctacttccacttttgcgtcttgttggttgtcgcaaccgacaagaatgagagtcagcgcgctcagggcaaaaatactttttttcatcatagatccttggttaagaaaggttgaccatcacaaacacgactaatatgaactcatgccgttaagtcctagtcaaacgcgcgtcattttagcgacaagttgtgtgtgatctagctcaataaaagcgatatttcccaacagataataaatagtcatttgcttgtggagaaggatacccctttcctacttgccgcctacagacgacaacgccaaatcgtttggagagagcctgttgagcagagaccagagggagataataaaagaccctcatcgatgagggtcttgaagcggttatttttcgtcatccggcagtttgacgttgagctcaagcaccgagatatcatcgcctttatgctcaaaagagagttcgaccatggatgggtcaatcgcgacgtatttggcaatcactttcagaatgtcttctttgagttgtggcaaatagctgggtgcaggatcgttttggctacgacgctcagccacaatgatctgcagacgctctttggcaacgctcgcggaagtcttcttctgtgggcggaaaaattccagcaatgacatagcgttaacctccgaataagcgtttgaaaatacctttcttcgcttcagtcaggaaacgaaactcaacttgttcaccaagtagacgtgccaccgtatcttgataagcttggcctgcatcggattgatcgtcaaaaattactggaacccctttgttcgaggcgttcaatacggcttggctttctggaatcacaccgagcagcggcacatgtaggatttcttcgacgtcttgcacactgagcatttcaccttgagtgacgcgtgcagggttgtagcgagtgagcagcagatgctgtttgatcggcgcttggccttgttccgcccgcatcgatttagaatcgagaatgcctagaatacggtcagagtcgcgcactgacgatacttcagggttggtggtgacaatcgcttcgtcggcgtagtacaacgccatcagcgcgccttgctcaatcccagctggtgagtcacaaatgatgaagtcaaaacccatctctttgagatcattgagcacgcgctgtacaccatctttggttagcgcatctttatcacgagtttgagaggcaggcaggatgaacaggttttcgttgcgtttgtctttaatcaaggcttggttgagcgttgcttcaccgttgatgacattgacaaaatcgtacaccacgcggcgctcacagcccatgattaaatcgagattacgcagaccgatatcaaaatcgatcacagcggtttttttgcctcgcagcgcgagacctgaagcaattgcagcactggaggtggttttgccaaccccgccttttcctgacgtgacgacaataatgcgcgacatgttattttttcctttcaatcttaaatcgtgagcgtttcgagatagagcgattcgtcagtcatactgagcatcaccctctgttgccagaactgactttcaatttgatcacttaaccaatagcggccagcgatggaaatcaattccgcttgcaaatcatgacaaataattcgtgcttctcgttgaccactcgctccggcaatcgcacggccacgtaacgtgccataaatatggattgaaccatcggcgatcacttcagcccccgcactgacgtgacttaagatcaccagatcgccgtctttggcataaatctgttgacccgaacgtactggggtacgaatcactttggtcggagccatttgcgctggggcttgggctggggagtttgtggcggtcattactgcaaaaccggcttcgacggcaaggttttggctacgtttgtctttacatcctgtgacaccgacggggattaaacccgcttggctgatcccttgttttaacgcaggataatcaatatcgccctcgactttcgccacattgatcaccactggcgcattggcaaaaaaggccggggcttgcgcgatcttttcttgaagaaattgaacagtatgcgcaatttggttgtcagaaaggtgtaataccgacaaagtaaaactactacctttcaggtcagggtttttcgacatggtaacgttgacctcaataaactctatgccttacggagagagcattggctgagaacagggctgtcatgttatattcagcgccaaagcacagcaagttctcttgcggtgaaataagtgatttggcatcaattttgatcaaagttaactgaattaagacaaaatgccctaagtggtcaataatcgaaataaaaggcttgtcatgctttgctctatttacaaaagtcctaaaaaagaaggcacttatctctatattccgaaacgggacgatttttcacaggtccctgacaccttaaaacagatgtttggtaaacctatttttgtcatgctggtcaatcttgagcagcgtcggttggcgcaagtgaatgtggagaaggtgaaacaatccatgcaggaacaaggtttctttttgcagttaccgccgccaccagaaaatttgctggaacaacataaggagcgcaaagcgcgccaaactccctgatgaagatggctcaaggagggcatcttgaaaaaattattatcgatagtactgggcctagcgttatcggcacccgtactcgccaatgaagtcagttttgaacaatatgtcgaaaggctaaagcagcaagcgcgtgaagaaggtatttccgaacgtatcctcaacgaagcgtttcgtgatgtggaatacaagcctcgttccgtcgttgcggataaaaatcagccagagaaaaagttgacgctggatgaatacatcccgcgcgctgtaccagagtggaaagtaaagcaagcgcaatctctgtatgaaaaacactacactgagctgcaacgcattggtaagcagtatggagtacaaccgagatttattgttgccttgtggggggttgaaagtaatttcggtgcgttcacgggtaactttcgggtgattgatgcgttatcgacgctggcctatgaaggccgccgtgaagagtttttccgcaaagaaaccatggccgccttgcagatcctcgaacaaggtcacattgcccctgaagccatgaaaggctcttgggcgggcgcgatggggcagtgtcaatttatgccaagctcgtttttgaattttgccgctgatggcaacggtgatggcaaaaaagacatttggggaacacgttcagacgtatttgcttctacggctaactatctcagccaatcaggctgggatgataagtacacttggggacgccaagtgaaaatccccaaagggtttgaccatgctctagaaggacgtcagcctgaaaaaggcaaaacgttacaagagtggagtaagcttggggtcactcgttatgatggtaaaccgctgccagcgctttctgatgatattaaagcgtggctcatcatgcctgatgatgaagcagggcgaatttatcttgtgtataacaactacaatgtattgatgaagtggaatcgctctcattactttgcgttggcggtcagccatctggcggatcggattgcgttctaacctgttggattggcgcaacggattggcaattagcgaacagagggctctcattgagccctctgttttttctgtttgtgagcaacgggtttttaggcatttcggtaatcgggatgtgttgatgaagaaggctgtgatggggagagtttgctgatggagatgcgatttgtttgctgaacgcgcgagccaaatggctttatttgcggtgttaatccaacatcaaagttttactgctgctgcgcacgcgctaggcgtgtcggtgtctcatgtcagtaaacagctcgccgcgttagaggcctcgctgggcgttaaactggtgcagcgcaccacgcgcagctttactctgacggatgctgggaatctgttttatgcccagtgccgtgaacttttaacgattgtgaccaatgcacaaagtgaaatggaagatcagcgtgatgaagtggtagggctgattagacttggtttatcgcaatcttttggcaccttgcatgtgttgcctgctttggagcagcttcgccaacaatatcctgagttgaacgtcgaagtgcatctgtttgatcataaagtcgatatgctcaaggaagggttggatttatggatcaccagtaacgagcagctaccagagggttatgtggcgcagcgcattgccgattgccgttttgtggtggccgcatcgccagactacctgctgcgttatggatcacccacagaacctatggccttaatggagcataactgcttgatttatcgaagctgggagcgcgattacacccgttggtcattcagccgagatggacacaatcaaaccattaaagtggccggaaactactcggtcgatctggcggaggcggtacgcgatgctgccgtggcaggatggggaatcgcttatttggcgacctatttgctgcgagatgaatttcgcacagggcagcttattcagctgctgccggagtggtccgccaatcaacagatgccgttttatgcggtgtatcccagtcgtcaacatatgccgaaaaaaacatcggcggtgattgaatttatcaaacagcggctcggtacgccttgttactgggatactcgtttacaaccttatgttcgttttgcagcagaatagcttctggcgacttaacgccgtagccgtgtggatcatgtttgctctccttaatgacgccgcctttcgatactcggtgagattagctcactggcttgctagtgcaacaggagatcgctgggggtatattccatgaggattattgctgtttttaaaaagatattttcccaatggaaaagataactcaaaagcaaacgtttaggtttaataaaatcagcaagttatgaaaagacgtattttgattaccggtttggtaatgagtgattaacaaactcaccttgcgcatacgatttccttcactaaaatcgccgcctttcctgttctactcacaatttgggcggcgttatgtcatcactcctcggtatgggcgcaattttgctggttgcgtggctattttctaccaatagaaaaaatatcaacttgcgtacagtttctttagcgttactgctgcaaatcttcttcgccttactggtgctgtatgtacctgcgggtaaagaggcactcaatcgtgtgacgggcgcggtgtcacaactgatcaactatgggcaagatggtatcggttttgtgtttggtggcctcgccaatggcagcgtaggttttgtgtttgcgattaatgtccttggcatcatcattttcttctctgcactgatttctggcctttaccatttaggcatcatgccgaaagtgattaacctcatcggtggtggtttacagaaattgcttggcacaggccgtgcagaatccctttctgctaccgcaaacattttcgtgggtatgattgaagcgccgctggtggtgaaaccttatcttcataaaatgaccgattcgcaattctttgcagtgatgacgggcggcttagcgtcggttgctggtggtactttggttggttatgcctctttaggtgtggaattgaactatctgatcgcggcggctttcatgtctgcccctgcgggtcttttgatggcaaaaatcatgttgccagaaaccgaacacgtcgatgccgcgattgcgcaagatgagttggatctgccgaaatccactaacgtcgtcgaagcgattgcggatggcgcgatgtcgggtgtgaaaattgctgttgcggtaggggcgactttgctcgctttcgtgagtgtgattgctctgttaaacggcttgctcggttggtttggtggctggtttggcatcgagctaagctttgaactgatcatggggtatgttttcgctccggtagcttggctgattggtattccatggcatgaggcgatcacggcaggctcgctgattggtaacaaagtggtggtgaacgagtttgtcgctttcattcaactgattgaagtgaaagagcaattgagtgcgcattcacaagcgatcgtgactttcgcgctgtgcggttttgcgaatatttctaccatggcgattttgattggtggtttgggtagccttgtacctgaacgtcgctcttttatctcccaatacggcttccgtgcgattggcgcaggcgtattagctaacctaatgagtgcatcgatcgctggagtgattttgtctttgtgatcacagattgatggattgaggccagcgagtatgctggcctttttttgttattcctaaatcaccgcttttagtagtggtgattgttttaaagatctcctttttatttcgtgaatcgcgccgaaaaagaattgaaagcgatgattaaccgcagaagaagcagtgacactgtgccgagaacggtaaactattccattgattaacatgcaaatctttcactctggagtattagttataagcgacatcatctaatacaggagagaaacatgaagcgctattgtttagccgccgtgattaccgccagtttgggggtaagttactcagcacaagcctataactgtgccggagtgccagtgtgggacagcagtacagtgtatgttggcagtgataaagttcaaaaaaccaacaccgcttaccaagcgcgttactggactcagggtaacgatccggtaacccattctggtcaatgggacgcatggcaaattcttggacagtgtgacggaggggcgaataacccacctcaagtgtccattcaatcaccactcaataacgccaagatcccacaaggctccgtcgtcggattacaagccaatgcctcagatagtgatggcagcattactcaggtggagtttttagtcggcacacagcgtatcgcgattgaccaacaagccccataccaagtggattggacggcaacgctaggagccacttcagtgaccgcgattgcgaccgataaccaaggtgcaaccaccagcagcaccgtaaatatcagcgtaacgcctactggtaacccagttccgccaactgtgacgttgactagcccaacgggcagtgaacagctaaccgtgggcgatgttctagccgtggccgcaaatgccactgacagtgatggcactgtcaacgctgttgaattttatgttgatggccaacttgttgtgatcgatagctctgagccttatcagtttaattggaatgccgctgtcggcagccatacctttaaagccaaagcgattgataacgacaacctgtctaccctgagccaagaagtgactttaacggtcggcagtggctcgaatgcaggttgcgcgggtttacctgtgtattcggtgggaaccgcgtattcggcagggcagttggtacaaaataagaaccaaaaatatcgctgtgatatcgccggttggtgttcttccagctccggttgggcgtatgagccaggggttggaagttattggaaagaagcatggagtggtttaggcgcttgttcaacgccacctgtcgtgacattaaccaacccaacggcgaaccaagtgattcttgctggctcaaccgtcagtgtggcggcgcaagccagtgatgccgatggctcggtcatgcaagtggagttttttgcgggcaacaacagcttaggcgtggtgactcaagcaccttacgcggttaactggctagccactactacgggaaatcaaaccctgaaagcagtcgcaaccgacaacgacagtaacaccagtgaaagcgcagtcagcgtgacggtgagcgatcaagatctggtggtttcactgacttcaccgacatccggccaaaccgttggtctaggtaaaccggtcaatattgccgccgatgctacgtcactaaccaataatgtggcgaaagtggagtttgtggtcaacggcgcggtagttgcaacggatacaacagagccttttgcttacagttggacgccaagtgcgattggtaactataccgttgccgcgaaagcgactgacgcagcaggaacgagcgtgacctcttctgctgccgcaatcagcgtggtagagcaagcgcagaagaaacatcgcttgattggttactggcataacttcgtcaatggtgcgggttgcccaattcgtttggcggatatgtcacaagcgtgggatgtgattgatattgcctttgcagaaaacgatcgcaacagtaccggaacggtacatttcaacctgtatgccggtgatatttacagcagttgtcctgcgctcgatcctgcgcaattcaagcaagatatgaaagcactgcaagcgaaaggtaaagtatttgtcctttccttaggtggcgctgaaggcactattacccttaacactgatcaagatgaagccaacttcgtgagcagcctgactgcgttgatcaaagaatggggctttgatgggttggatgtggatctcgaaagtggttcaaaccttgttcatggctcacaaattcaagcgcgcttaggccgagcattgaagcaaatcgagaaaaacatcggtggtgatatgttcctcactatggcgcctgaacacccttatgtgcaaggtggtatggttgcctacagtggaatttggggcgcttacattccggtgattaacgaagtgcgcgatacgcttgatattctgcatgttcagctctacaacaacggtggtttacctaacccatacacaccgagcgcggcaccagaaggctctgtggatatgatggtcgcccaatcaaaaatgttgattgaaggcttcactttagccaacgggacacgctttgaaccattgcgtgatgaccaagtagccattggtttgccatcaggtccaagttcggcaaattcgggtcaagctccaacccaaaatatccttgatgcgttggattgtttaaccaaaggaacccgctgcggcaccatcaaaccagcctttgcctaccccaattatgcaggcgtgatgacctggtcaatcaactgggataagcacgacggctttaatttttccaaaccggttggggataaacttagccagatgaataatgctcagtaaatccgttcgttgagtttcttttatcgccaaattcacctcagttacgctggggtgaattttttatggcacttgtctagagagttaccaataagtaaagaggttggttgaaatccgtggagggtaagtgaagatagtccgcgataggtttgactcaacatcacataagcacgcttttcgtagcacgtatatgatgcggatcaatatctcataccccaaaaggggtaggatgatcgcatatttataaatgtaaaaggatgtgtaagcttatgtcgatcaaaaaaaggtatgttgcactgcttgttgccattggggtggcaattggctgggtcactttaggtggcagtgctgcagtgatgcattacacctcaagcaccgagttttgtctctcctgccattctatggagatcccttttaaggagtatcaaggctctgttcacttttccaatgcgaaaggcattcgcgccgaatgtgccgattgccatattccgagcgatcccatcggttatttcgtcactaaggtacgagcgaccaaagacatctaccacgaatttgtaacaggtaagattgatacgcctgagaagtatgaggcgcaccgacaagagttagcggagatggtatggcagcagatgcgcggtaacgattcggcaacgtgtcgctcttgccatgattttgatgccatggagccgtttgagcagtcacacgaagcggtgaaaatgcatgagtatgccaaagccaataaccaaacctgtattgattgccacaaaggtgtcgcgcacttcgcacctgaagcggagcttgatagcaaagcctttgaaaccttgatggcctttaccgaaaaaacggccgctgacgcgcagcgagtttaccccgtcaccacgattgcgatgggtgaattgggtacgatcaacccgacgactgctctggatgttgtgagtaccaagggcactgaacgtaccgtgcaaatcaacgcttaccaaatgaaaggcgcagaacaagtactgtatatgggtgaggggcaacgtgcggttgtcgcgactttaactgaacaaggccaaaaagcgctgcaagcacaagactacaaaaccgatgcttacggtaaccaatggcgcgcggtgaatttaaccgccaccatcacatcgcctgtggtggatagtttagagccggtttggtcttatgccgaacagcttgataacgtttactgtgcgacctgccatgcgaaaattccagccagtcactttaccgtgaatgcttgggggccagtggcgaaaagtatgggagagcggacggatatttccgctgagaatctggagattctcaccaagttcttccagcaccatgccaaagatatggttagccactgagtataagtagagggataacgttatgactaaaatcacccgccgtggatttttaaaaggcactggtatggctgccggtgcaatggctttcacttcattttcaccactctcgattgccagtgataacgcacgtggtaaaggcgtgttaacggctggacgtatggggccacttctctgtgaagtgcaagatggcaaaatggtggcgaccaaaaatgcgctggcgcaaactgtaccgaacagcttgcaatcgacaggccccgatcaggtgtatacccaagcgcgggttaaataccctatggttcgtaaaggctttttagcgaaccctgccgcaccgaaaggagtgcgtggcagtgatgagtttgtgcgcgtatcgtgggatgacgcgtatcgcttaatccatgagcagcatatgcgcattcgcaaaacctatggtccagcttcggtgtttgctggctcttatggttggcgctccagtggcgtgctgcataaagctcaaactttattgcaacgctatatgagtatggcgggcggctattcaggccacttgggagattactcaaccggcgcggcgcaaatcatcatgccgcacgtggttggttcgattgaagtgtatgagcagcaaaccacttaccccgtagtgctagagcacagtgatgtggtggttctgtgggggttaaacccgatcaacacattgaaaattgcgtggagctcgaccgactgtgcaggccttgaattcttccatcaactgaaaaaatccggcaaaaccattatcggcattgacccgatccgctctgaaaccatcgagtttttcggtgagcaagcccaatggattgccccacacccaatgacagatgtggcgatgatgatgggcatcgcgcactcgctgatcaagcaaggtaagcacgataaagccttcttggacaaatacaccgtaggctacgatcgctttgaagcgtatttgctgggtaaagaagatggcgttgaaaagtccgcgcaatgggcagaaggcatttgtggcgtaccagccaagcaactagaaacgctggctgagattttcagcaaccatcgcactatgctaatggcaggctggggtatgcagcgtcaacaatatggtgagcagcgtcactggatggtggtcaccttagccgcgatgttggggcaaattggcttgccgggcggtggttttggtttctcctaccattactcgaatggcgggaacccagcgcgtgacgcgggagttctgcctgccatttcggcagctattggtggtggctcttcggcggggaatgattgggcgatttcaggggcgacgcaaagtttcccggtcgcgcgtattgtggaagcgttggagaatccgggcggggcctatcaacacaatggtcacacgctgaccttccctgaaatcaagatgatctggtgggcgggtggtgccaactttacccaccatcaagacaccaatcgtctgatcaaagcgtggcaaaagcctgagctgattgtaatttcagagccgtattggacagcggcggcgaagcatgccgatatcgtactgccgatcaccacaacgtttgagcgtaatgacttgaccatgacgggtgactacagtaaccaacacttggtgccgatgaaacaggtggtggagccacaaggcgaagcgcgtaacgactttgatgtgtttgccgatatggcggaaatgatccgtcccggaggccgtgatgtgtttaccgaaggcaaaaccgagatggaatggttgtacggtttctacaaaaccgcgcagaagagcggccgtgcagcacgagtggcgatgccgaatttcagtaagttctgggaagataaccagctgattgaaatgaagtggaacgcgaaaaatgctcagtttgtgcgttacgccgattttcgcgcggatccgatcctcaatccattaggtacaccgagcggcaagattgagatttactctaaaactctggcgggctttaatttgcctgattgtccagcccatccaacctggttggctcctgatgaatttacaggtaatgcgaagcagggcgagttgcaattaatgacggcgcacgcggcgcaccgtttgcacagtcaattcaactacgctcaattgcgggaagagtatgcgattgctaaccgtgagccgatctggatccacccagaagatgcggcatcacgcggcattcaaacgggcgatttggttcgtgcctataaccagcgtggccaagtactggtcggcgctttggtgacggatcgcatcaaacaaggctcagtctgtattcacgaaggcggctggccagatcttgatccgcaaaccggcttatgtaaaaacggtggtgcgaatgtgctgacttcagacattccgacttcacgtttggcgaatggctgtgcggcgaactcttctctggtgcgtattgaaaagtacacagggccagcgttggaactgacggcgtttatgccaccgaaaaatggctaatcgcgagtgataagaaaacactaatagaaagccgaggcgagtgcctcggctttttgcgttcttaaccgacttgctgctttggctgaagcctaagccgaggtgagttcagcttgttcaacaatacgattgtgcggctgccaaggtgagttgattgagtctggttgtagatgaatagaccagtattcgttatgcatcgaactcgtatggctcgcttgcaaggtggttaaattattcaccaacagcaaatcgccagtttgtagcctgtactcaaagcaaactcttgggtcatgacataacgtgttgaggcgttgatagacccgcgactgctcggttaattcgctgaccccttctaaatgagtgaggtagccctgcgcatgctgaaaatcttgccaacgcagcacatcttggcgtgatgtcgaacagtaacggacgagggggtgtaaagtattcccgccatgttcaggtgaaaagttgctgtagtgcatgatggtgttacgcagctgttcgcgctcttgaccgttgatggtcaggacggcgagtgcagcgtcaaccacggtccaagtattcgagtctggtgatgcaacgctgtaaacggcgtactcatggggggtgtaatcttcatattgatagcgatgtgggtgtacggccatataagcgggtgggcaggagagctcccaatgtaaaggttgctcaccagcactgcctttgaaggcttgtacgctaacctcataagcccaagtgacagcagaacggtgattgaggtaccaagtttgtagctgttcagcgtcagccagtggtgcaaaaccgcgcagcaaaaccgagccaaattctttgaccagttggctgagctctttgggaagtagcatatccagtgaagcgcgattggctgggcactctaaatacaaccccgatttttcatgttgtaattctgcccgtatttggcgcagcgcatgggcgtgcacttcatcggctgcgctcaattgcaggtaacaccaaggcttaccatcatgagtgacaggcaagatcaccccagaacgttttaagtgattttctttactatcaataatgaattcgccgcggctggcatcaaacagcaaagtactgtgccaaggcgttttgaattggcgttcatggaacagaaacagcgagtatttcttacctatcatcggatgttcatgaatgcttaatcgaatgcaatcggcaaatttttgctgcaagaagttatccagcgctttgccttgcaccatcatccccttagcgatatccgcaaggcgacgtcggcgatctttgtatgagagaggagcaagaacgaatttctgatcctgattcatgaattttttcaaacccagataggtttgattcatcttattattttttaatttaagttcagtgaaattctctgcatagtcaggatcaccaaacttctcacgtaatccatcaaaatattccgtgtctttcagatcggaaaattcatcaaaatgttcgaaattgacaatttttaacgcatcgctgcaattcatgtttgctaccattttacgcagattgtctgagtaatcataatggtggtctaagtcgacagagatataatcagagaatgtatgatagtcagaaaagatataaaacgtcacacccggttcataaacggattcaatgtcacggatgcattgaacaaactttcttaaaacgacatattcaccgagatcgggtgtatggctaagtactttatctaagttatttgttttacaggggaaagcggggaggagtaatttaattttctcttggctatttacaaatctacgaatttgactttttaagttagcaagcccgttgtaactggcattgcattgtgcaattagttgatttagaagaataaatgagatcttctctacataggtttcttgttgagcatcgagcataaattttcctcattcgttggattggttgaatgcaattcaacatattcaatacggtcgttttcttgttgagtaatttgtgcacaaatgagaatgacatcttggctcattattgaaccattcatcagtaattggataacgtatctactcatctccccgtacatctactctaggtgaattaattccgcacataggaattggaattaatgccacaaattcaaaaaatcgtttggttatatgaaatctgcttgaaaccaataaaaattactcatctctaacaggcggaattattatttctgctattccttgtactgactagataatgaaaatagaacccaaagttactaataaaggaacagtcatgctaaatgagttaaaacgcatagtgatattcaataaagtggttgagtgtggttcttttacttgtgcagcagaagcattaggtatgaccaaatctaaggtcagtgaacagatcaccgctttagaaaaaacactgaatgtgcgcttgctaaaccgaactacccgtaaaatcagtttaaccacagagggggacacattttatcaacgcagccacggattattgaatattgcggaggaggcgctttgctccgttaaccacttagcgtcagaagtttccggaacgatccgcattggtaccactattgatgtcggcacttttttgctcaacccgctactggctgagttttataagcagtaccctaaggtgaatttcgatattcagctcgatgatggactgcaagatttggtggattctaatctggatatggtgatccgaattggtgagctgacgtcatcctctttagttggccgtgttatagcgccttttgagttaggtatttatgccagtcaaacctatttagagaacgcgccgccgatcaatacgattcaggatttagagcagcatgattgggtctatctcacacgcttaaatctgcctaaccaaaccctaactttaaccaatcaagagggcgtacaacatcaggtcaaattccatagcaaacacagcagtaattctccgcttggcgtcatgaccatggtgcaaaatggtttgggtgtgggatcgattgccagttttttgattgataagttgcctgatgcatcgctggtgcgattgtttccggacttctatcagatcagtactaccatgaatattctttaccccagtcgtaaaaatttgccgccaagggtgcgtttatttatcgattatctggtgggaacattgtgtggttaatggagagtgtttaaacaggtagagccaacgcgcaatgagccgcatgggtgtgtcgatggcttctagtgccggggaaagtcaccaagcccgtttagggcttgatgaagatcgagtgaacgcaggtattgaactagtgagataagttgaattctgtcaacacaccttctgccaacacactgtgaacctgatgcagtggagtgacccattcgatgtaagcatcagggcgaaccaataccgcttgtcccggataaggtgcgtgacgtgtccagtgttgagcattttcggattgggtaccgatgcggattacatgtacatgcggcggcacgtcaaccacgcattcgtcatcattaaacaagaacagtgtccatcttgcgtagtcaagcagtgagtacaaacgagtgatctcagtaccttgattgagcacgaaatcccacattcgagtgccagctaagccttcttcggagtagcgaatgcccattcccgtgatattacctgaacgcttttcaacgatttttacgtagtcttgcgcatgggtgttggtggctgaaaacttcgttgagcgtaccagttcgccggagctgtctatcacgctctgcgccactggttgacgttcagcgtgataacttttcaataaagcaggagaggcttgacctttaatcaccatactcagtttccagatcaggttaaatgcgtcagcaaccccagtatttaatccttgtccaccgttgactgagtgtacgtgacaggcatcccctgcaaggaaaacccggtcatcgacgctgtaatgttctgctaccgattctttcacggcaaattgcgagaaccagaccacttctttaaaacccaattgatgaggtgccattgcccggttaattttggcgatagcctgctctaaggtgaaatcgtgcgtatccatacggacataaaagcgatcgatttcaccttcgcgagggatccatgccacatctgaggtttctgcttggaacacaataatttcagggactttaggaaagtcactgtcaatcacaccatcaatcaccgcccagataatttcggggcgcacaatgtgaaaaggcacattaaaatggcgacgcacaaaagattgagacccatccgcaccaatcacaaagcgcgattgaataagctcaccattgctgagatgagttaggcagcctgcttgattgagctcgatattgtcgacgcttgtgttgcgccaaacgggggcattcgcttcaagtaatttcttgtccaatagctgctcaacaaacgattgacctaacatcaaaaagtgtttgtgcaagcagccttccaaggcttcccaccagctcgattggcgcgagataaaatggccattagcccaaaccgagctggtattacacggcttgcctaaagggtaaagatcatcaaaaagcttcgcgacttcgagcagttgtaaggtgcgggcatttaacgcatcggcgcgtccgacttgaagtggttcggctgacttatcaatgatcagcgcgtttaaaccgcagcgctgtgctaagtaggcactcattaacccaactgggcctgcgccgataatgacgatgtcggttatttttgtggacattggtacgactccaagcttggattgttataaggaggattacttaacacttgcacacgacgaatgtgacgcggcgtgtgagaggtaaaggcttcacggccatggagtaaggagaagttatcggtgatcactatgtcacccgtttgccactcatgagcgtagaagttacgtgggtcgtacagtgcacggcgtaaacttttgtgaaactcgatcgcttgctcaggggtaattccagacagtgatacatcaggtggattgagcaggtcgccattttcttcaaaatgcggctcgttgtagcgtattacttgatagtctcggtatggatgctgcatcacaatcggggagacggttttactgtggtaaaactccattttacgctggtagtgtccggtgacttgctgccaaagctcaagatctggctgaggggcgtgctgtaaagccagcatggtatgactgaaggtcgtacgcccgccatgccccggtaaaggagcctttacacactgaaagatttggtattcagggacttgtgggcgatacatgccatcccaatgcatcggcatgtagctgctgtcaaaaatgtgatcgccaggatcctctttttgtaccagatctaatacgcgcccaaacggccaaacactcacttctccccagcgttcgcagtagtccgcaaactgctccgaatgttcaaaggtttcaaaaccacgcagtaacacaagttgttcacgcaaaaagagttcgcgtaactcatcaatatctaactcattgacatgaatcggagcatgtttcggttctacgatcactccaaacggttgcagagcggtaattttgtacggcatatcaatggcctccaaaatgggcttaggtttttcctttatctagtccgattatttgtacaaccgctggaattgactagataacaaaagaagaaccgagagttaccgatacaggaacagtctctgcgttattgagagagaagggaatacctatttagaaagaggggggagtataaagcgcaaacagaacgaaagaggtcaatccatgcatggtattgacctcttactgcttctcaggtgttagcacaaggcgttaacacaaggtgagtgtgaataccgcgatgcagatagccactgtggctaaccttgagtgtggaactgctcacacgccatcatagtgttttcaatcaagcttgcgacggtcataggtcctacaccaccgggtactggagtgataaaacttgcacgcgtacgggcaacatcgtattccacatcgccaaccagcttgccagtatctaagcggttaatgccaacatcgaccacaactgcaccttctttaatccatgctcccggaataaagttaggtttaccgaccgcgaccaccaagatatctgcttggcgaatatggccttcgagatcttgagtaaagcgatggcaagtggtggtggtgcagcctgccaagagtagctctaacgtcatcggacgaccgacaatgttggaagctcccacaatcaccgcgtgtttgccgcgtagtggaatattgtagcgttcaagcagagtaataatgcctttgggtgtgcaagagcgtagtttcggaatgcgctgcgccaagcgaccgacgttgtaagggtggaagccatccacatctttctctgggtgaatactttccaacactttggtggtatccatacccgcaggtaacggcagttgtaccaaaatgccatcgatttgcggatcgttattgagttcttcaaccagtgacagcaaggcttcttcgctagcggtggcgggtaaatcgaaagatttggagacaaaaccgacttcttcacaggcacggcgtttactgccgacatacacttgtgaagcaggatcttcgcccaccaacacaaccgccagtcctggggctcgtaacccagcttgaacacgagctttaacacgggctgccacttctgagcgcaccgtttgcgaaatcagcgttccatcaatattttgagcagtcatgactttccttacaggtttggagcgaaaatttttgcgcacattgtcgcagatatttttgataacatccacaggcaaacgtttgctttgttctgtttttcggcagttgagatgagatcggtaaaatattgctcattcgaaacagaaagttagacaaaggcgttgatctagcccgtttaactcgtataatcctcaccctgtagcgcgcccttagctcagttggatagagcacgtgccttctaagcatgtggtcacaggttcgaatcctgtagggcgtgccattatttcagaccccagcaaagctcatttgctggggttttttattgtcatcctcaaatcactgttttgagcggtgacggttttaaattttgttgcgttgggtagttgagaagtggcgattttgcatcggtatcatcgacaagctgtgcgacctctcggttttttttatgccccctatttacaaagccatcaggtggtgcaaggatccgcgtgctcagggaaaggtaagtccaaactagatatcaccatcctgccgtattacccaatatattcaaccgcttatccgcatttttagtcgacttggtatttttgtgactaccaatttattggactgaaaacgcagggagatacccatgaaacgcatccccgcattggacagtatccgaggattattgttggtgctgatcaccttcaaccatcttatctggtacagcggcggtacaaccatactgcaaatgattactcatgaacctgtcggcgtgtttggtgccgcggaaggtttcatctttatgtctggactactggctggtatggtctatagccgccgtgaatacactgaccgtcaagcggctgggaaagtgtggcatcgtgcgttcattatctacaaataccacattgcaggactctttattgctatgctgtggttttggctgggcagccactattttgctgaacaagtcaccgtgtttggtggcagctttagtaatctgcctactatgccttttatgaccatgttgatgagcttcctgctgctcaataaacccgcctatctggaaattttgccactctatatcatgtatatgttgctgtttcctttggcactgtacgggtttcgtcgcggttatcttaaatgggtacttgcgctgagcgtgctgatttgggcaagcagtggttggattcaaggcgctatgcttttgccactctttaagtggctttctgcagaatacattcctgaactcggttactttgacccttttgcttggcaactgctgtttttctttggtggtgcattaggttattgcaagcgtcaaggcgagttggcgtggttccaccctaaattggtttggttatgtgcggcgatagctttggttatctttatggcttaccgcgatcttttaacgccattgggtattactaagcagatggtgtatgcggcatccagtaagccagagcttggctggttgcgtgtactgagtttgagtgtatggatctacttaatctctgttgtgatccgctttttcccaacggcattagtgtatgaaccgctgagctatctcggccgccattcattacaagtttttacttggcaaaccgtactgatttttatcactgcaccttggcttctgaccacgcgcgactcggtttggcatacagcgattattctgctgctctgtacaacattgtggattcccgcttggctacagacacagcgtaaagaaaagccaatcaatttgtcatctgcggtggtggcttgcctttcactggttttagtgatgacgacgaattttacaagcttccctcaaccacccaaaagtgacattgtggcgagcagtgatgaggtcgtcaccgatgctttacccagcagtgagatttctaatcatgagctgctgagtgaaccgatgaacagtgatgagacacccgtgaactgagccagaataaactgtcccgtgtatgttatgccgatgccgtttttagctgcatcggctaacgcagttgtcggtatacctgcgtactttttctgactaccttcctcgccggataattctttatatagccatcaagaccttactgaggtagaccgttttgatgccgaagcttaagaccagctttggtaactcacgaggtatttcaaatcgcggctacgtctattggacagcctatcaaccgtcacattctcgcgttacagtgagtttttatcattcacgattttttgaagccagtacaacctgtgagagcctgaaatgagcaagcccctttatgtgtttgatttggatgacaccctgattgatggggactgcgcaatgatttggaatgcgtttcttgctgagaaaggcattgcgacggagcgcaattttgtggaagaagatcgaagacgcatggcgctgtacgcgcaaggcaagatggatatggcggaatacattgcttttgcgatgcagccattagcgcaagtgccaagtacaaccgtgcaagattgggtggaagagtgcgtgtcacgctggattgttccaaaacaatttgcccaagctcgtgagttgattgcgcagttaaagcagcaaggtaatacctgcttaattatttccgcttctgtttcgtttttagtgaaaaccgtcgctcaacgtttcggaattgaacacgcgttagggattgatcttgtgagccaaaacggttgctacagcggtaacatcgagggcgttgctagctaccgagaaggtaaagtgctgcgtttacaacaatggttagcggagcagaatgaaacctatcacgacgttcatttttatactgactccatcaatgatctgccgttatgtcagcatgccgatttcgcgtatgtggtcaatccctgcccgcgcttgaaagctcaggctgagcagcatggttggcccatattatcttgggcggtgtaagtgtttggccatccatccgtgttacggtgggcggatggccaattcgctaactaaagtagagccagatacccaccccagccattagcgaacctgcaatccgattgagtaaacggacatggtgagcttggcttaataagcgctttaacccttttccacccgtggcatacaaactcatgctgataaattcggaaagcagaataatggcaaccaatacagtcagttgtggagcaaggcttaacgattgatcaataaaagggggcagtagggataccataaacgcccagcctttagggttagcaattgcggtcacaaaaccttgtactaatagaccccagtcactgccttggtacgtgttttcttgctcgatattgatcgccagcttgccccgtgaacgccacatttgcacacctaaatacaccaaatagcttgcccccacgattttaaacagagtgaagatatctggataacgcagcatgaccgccgcaatgcctaccactgcggagaccgcgaccaaagccacacccagtagttcgcctaccatcatccatagtgttcttcgatagccaacgctcatgcccagagtgagggccaaggtcatattcatacctggggtaatcgaaacaaaaaagaaggtgggaataaagagtcccaaaagtgccgtattcatccattctctccctagcctgaggattatcgtgttagttccattaacaacaactccacaatataggccgattgggaaatgcgcaatcttcaattgaatgaggcactttgaaggatgcagaatgtaacgtaatgacttgggttggtgagcaactatttgaaaatagcggagggttgggtacgtcgtatcggacactgctgttttgcagatagtcaccaagcgggtttgatcgcttggtgaccgtgcccttatcacctgaagtgggaacgtgctttcacctcaatcacagggtttgtctatgcattgtttatagagacggattcaccttgtagagtgtgaatggcttcgggcaccgtaggcggtagcaaggctttctcacccgttttaaagttaaacatcacaaccgtagcgctaccgacggtagtcactttaccaagtttttggctcaccacttggtattccatgctaaagcgatctgcttgaacagaggtaatgcgtgaaccaatcagcagcgtatcgggaaaagtgaccggaattttataacgcgcttgtgtctccgataacacagggccaatttgagtgcgttgtaactcttccatcagcttaagatgagcgaagtaatcaattcgcgcggtttcaaagtagcgaaagtagaccacattattgacgtgttgcagcgcatccatctctccccatgcgaccacgattttcgtgatcacagggaaatcttttaaaagcgattccatgcctttttactcgtgttgtgattagaacaaatattctaacggtaaatggcaattgtaagcttgagcttgttagcaaaacgttaaattcctcagctgtcgagggtttcgctatccagagtcgcttgggtttgagtgatacagtgagtcgccaactgctggtaatttttttgcatgacctgaacgaaatgttctgcatcactaaaaccggttaacggttcaccgatcaccacatcgcaattgaaaggtacgaacatcgccgtacctttgggtagtgcgcgccctaaaccacgcatgaccacaggtaataccgcacgctccgggtgatttttgactaaatgataaatgccttttttcaaaccactcattatttccggctcaccacgactcccttctgggaaaataatcagaatatcgccttgatctaaagcttcatggcaagcttgcagtaccgcgtcacgttcactgctggagggggagcgacggatcggaatgatgccaataatattcagagataaccaagccacaaagggattcaccagaaagtaatctgctgcagcgacagggcgcactcggtgaattaaatgcagcggaaacagagccatgagtacgagtgtatctaaatgactattgtgattggcggcaatcaccattggaccttgagtagggagattttggcgctgcaaaatattgagtcctaacccaataaaaactaagggtttaacgatcaataggaaaaacagcactttcagaatacgcgccatatgatcctcagtaatagagataatagaggtagtggaaaaacagcggagcagtaaacatcaagctatcgaccctgtccagaatgcccccgtggcccggaataaactggctggtgtctttgatacgcaaatcgcgcttgactgaagaaatcaccaaatcgccaataaatccactcaaggcaatgatgactccgccgaccaacccttgcgctgcggtcagtggcgttaaataaggcgctgcaaagtatgaaacggtaaccacggtcaatgtgccgccgataaagccttgccaagttttattcgggctgactttcggaacgatcttatgtttaccaaaactttttccccacacgtattgtgcaacatcattgaactgagtcattaccaataaaaacagcaacatacccagtgaacctgcatctgggtttaagcttggtaacaccaataggtaggccatatggctgatacaaaatacggtcaacatcattgcccagtgaataatgcctgccgagcgaataaaacctttagtatctccaatcagcaccatcaccataggcaggtataggaatacatagactggaataaagataatgaacatgccgtaccagccgatggagagccagtagtactgaaatggaatggacaaataagcccagaaaatcactcggcgatcggtcattcgtgtgggcacaatcgagagaaactctttcagtgccatgaaactgaggaaacctacaaaaaagagcgtgtagttgagtggaagctgcaatacgacaaacacaatcgcaaccatccaccaccatgaacgaatacgcagctttaattcgagataatcgcgttcaggatagcggcgagacagccacaaataacagagtgtacctaccactaaaatggtcaaaatcaccaacatcaagtgcagtgagtgttgaggaatgttgagcatgactagttaccttgatgatcggacgaggatgcacgcgccgcatggaattgataaatgtgctgtaagcgtcgccaaaccgtgagtaccagcccaatcagcatgacgattaaggtgagatccatggtgtatgcgaaaaaggttgggagctcatcgaacagtgaaagtgccgcgataaagagcaaactgagggtaagcagcgccatgcgatgctgtttagccatcgggccttgaaaatcagcttcaccgcctatgctgactcccaatacacgaatataggcggtcagcaccgcaagaagcgcacaaagccatgccaaggtcattcccagcgcagaagtcgtgacaaaacctgcaccaagaatcaacaaagggtcggcgatccgatccggtacatcattaaacaattcgccagcaggggtcttcttgccgccttctacggcaaccatgccatcaaacaagttacacagtaaacgcgcttgaatcgataaggccgccagaatgagccaaagcggggcaggatagtagtgatatacggccaaaatggcacagccaagcagcgcaaaggcaatactcatgagtgaaatttggttaggggtgatctgcttttggctcaaccaaacggcgatacgtttggtgaagttcagatctctgaccgcaagtgggcggcgatttttctcttcagattgtgtcttgtccatataacctcttgttgccacatagaaagagtggctagcaataggcgatgtggtaccaccaatccgcactgaaaagaagtcataccaagtagggttacctgttttttggcacgcgtctcaatcttgttgcattgtattgctaatgcattactcattaatttgcgtggataacgaggtattctctgaggaaaagtagtgatcgcaaaaagtggcgaactcggttttagtgataggacgagagaaatagtagccttgaaattcatctacccccaattgtttgagctgctctaattgcgccaactgttcgattccctcggccaccacctgcatccccagttgatgggagagattaacgatggaagcaataaaaatcgcttgttgctggttttgattcatattgtcgacaaaggatttatctatcttcaatttactgaatttaaggtggttgagttggtagagcgaagaccatccggttccgaaatcatcgagtgcaaagcgaactttcattttttctagtgactcgatgatggcgagactttgcggaaaatcatcaatggtcatggtttcagttagttctaatatgatcgcattgaggaaattctcatgatggccaaaaatcgtggtaacgagtgttggcaaggtttcatcaaacagagagttggaaaggttgatcgagacatctaatcggcggttgtgaggtttccaatcattttgtagtgccaaatagacctgctgcatgatccatgccccgagctttttaccaagtccatactcttcggcaatctcgatcagatattgcggattgatataaccaaactcactgtgctgccaacggatcagcgcctcacatcctagtcggtcaggatcgcgcgacaagataggttgataggataaatacaagctcgattggtttgggtctaacagcaactgctgtagctgctcagcgaggatacgcttcttgttgtaagcactttcaatgtcgcgcgtatagtacaccacctgaccttcaggtgcttttttggcgatattgagcgctaaatccgcattgtttaataaactgctcgctcgtaattttgagctgctctcagtgaagtcttgggtttggcaggtcacaacgcccatcgcgacactcaaacgtttggtcggatcattctcttgtactaatttggtcaagtcattccacaagttacggataaaaaagtcggcatttccggtacaaggatgcagtaaaacggcaaattcatcagcaccaatccgggcgcattgataagcaaatgagcgacagcgttgggtaagtaattccgcaatgttaatcagcaactggtcgccaaaagcgtaacccatcgtatcattcaactctttgaatcgattaagatcgaacaggataagcgcgataggttcttgttgatttcggcgtcttttctttagttttttaacgataaagttacggttttttagccgagtgagtgggtcatgccatgcgagaaattgttgataatctgcagaacgataagtcatataggaaagcaagattaacatcagcagaatcgctgcgaagaaatagagtaactgctgtttattctcgttaatcatacggatattgctgttggcactttcacccgtaaaattgacaatcgctaaattgcggatttgggcattgtagggctcgaggagctgcagcaattcttgcagtacgggttgatcacctcgacttactgccagttcatagcgtttgagttgagtgaacacctcttgaatgatggcttgcgcatcgtgttgttgtcggagttcttgggtttctttactcgttagaaagagatcgaaacgattccacaaaatatcgtaattaagactcatcgcttgatgattttcacggctgccatttaataagtaagtctccaatctatgagtaaaattgagcgtctctacttccaattgcgccaaagaccaagccgccagttgggtgtacttggtgagcatattataagtattagtaaagcgaaccatggcccagattgacagcaagaccatgacgaatactagcgtgaaaaatgcaagtagagacttcttcatcgtcgttaaggagtgatgatttctatactgctgatctgccaaaccatacggctgtgcagtatttcattgtctaactcgccactactactgagtggatagattgaccaaattggtccacggtcacggatctgcatcggtttgccattattttgaatcgcgaaaacagggttgtacttctcaatatcagaataagggatttcggcccaatatttgtttagggcaatcactttaaggtcggcttgttttactcccatccaagctaataatgcctgagcagaaatgcctttaaactccgtattaccttgtgtccacggtgtttcggtgacgatagttaaatcactgcgggctaacagttcttgataagtggccgaaacggtttgcccttgatgggttatcgtgaggatcggttcttgtgcaaacaatttgctgctgattaacgccaacagcgtcaataacatgaccttcattgttctcattggttgtccctttatcgtgagtgaggtttatataggtataggtagcccatttcacgcgtgcaaggtcgatctttagtttgagactaaagtcgatttcgctcatcccttggaagaactggcggcatcccacttttgtcacaaaaaattaacgtctcaatctcttgctgatttttcaaagtttcaccatattgtcattaccgtgtcataaacataaaggtgaggagatcgatatggaacacgttgaaatggtgcaacctagtgcgctaggtgttgtgggtcgtacgctggtgttttccttattggcattaggcttcacctttatgctgttatagcaacacctaagattcaccaaagccgaagcagattgcttcggcttttttatccgcgggtttttatccacttgagctgccttctaacacctttggtaagcataggaagaaaggggacgttgagcgagaggttcgggttatctttctccacaacgtcagcacaataaaacctagtgaaaaggtcaagtatttgctaccgtgcgagcaaaccattgatcgcgagtctagttatgtcagtgtggaatgctgttcatcttagccgacgttttgcggcgttaccccaagctttttataccccagttcatcctcagcctttgcaaaatgtacgttgggggatgtggaatagtcgtttggcgcaacaatttggtttgcctgaagcaccgaatgatgagttattgttatcgctgtcagggcagcagctacctgctgatttttctcccgtcgcgatgaaatacgcaggacatcaatttggggtgtataaccccgatttaggcgatgggcgcggtttattattggcggaaatggcgaccaagcagggcgaagtgtttgatattcatctcaagggcgcagggcttacgccttattcacgaatgggggatgggcgagcggtgctgcgttcatcccttcgtgaatatttgtgcagtgaagcgatggcaggactcggcattgccacgacccgcgcattagcgctaatgagtagtgaaacgccagtttatcgagagcgtgaagagcgcggcgcactcttggtacgtttagcccatacccatgtgcggtttggccatttcgagcatttcttttacaccgatcagcatgcgaacctgaaattactggcggataaagtcatcgaatggcatttcccagattgcgtgcaaacatcgaaaccttatgcggcttggttttcgcaagtggttgagcgcactgcactgatgattgcgcagtggcaagcgtacggctttaaccacggggtgatgaataccgataatatgtcgattctcggggaaacctttgattatggtccctttgcctttttggatgactacgatccgaacttcatctgtaatcactcggattatcagggacgatatgcctttgatcagcagccacgcattggcctttggaacctctccgcattagcgcatgcgctgtcacctttgatcgacaaagatgatttagaagccgcactggggagttattcagaacgcctcaatctgcatttcagccgtttgatgcgcgcgaaacttggtttagcgactcagcaagagggggatggcgagttgtttgctgatttcttcgcgctactggccaacaatcacaccgattacacgcgctttttacgcgagctctcctgtctggatcggcaaggaaacgaggcggtgatcgatttggtgttagatcgcgaagcggctaagacctggttaacccgttatcttgagcgcgctgctcgtgagttaggtcaagaggggcgacccatcagcacccgtgagcgctgccaagccatgcgccaagtgaacccgaaatacatcttgcgtaactaccttgcgcagcaagcaattgagtttgctgaacgaggcgattttgaggaaatgcaacgcttagccactgtgttggctagcccttatgccgagcatcccgagtttgaacgttacgcaaagttaccgccagaatgggggaaaaaactggagatcagttgttcttcctaaggccggttatgtatgggtggaaagtgacccattactgaaattggatgggtggatttccacccattttttatggcagaaacctcgaacacaagagaggaatgccatcactggttttacaagttactgattttaaataaatgttagttttgtgtaatgaatggcgcgcaagttgctttggtatgggtacgcagtccaatgatgggctgaaaaatccaaccaaggagaataagaatgttcaagccgcttaccctaattgccgcttctatcctcgctgtcacaagctttaatgctgccgctaattgtgacccaggcgaaatcgtgatcaagttcagccatgtgaccaataccgacaaacacccgaaagggattgcggcatcactgctggaaaaacgcgtcaacgaagagatgaacggtaaagcctgtatgcaggtgttccctaactcaacgctgtacgatgatgacaaagtgttagaagccttgctcaacggcgacgtacaactggcggcaccttcgctgtctaaatttgaaaaattcaccaaaaagtaccgtatttttgacctgcctttcctttttgaagatgtggatgccgttgaccgtttccaaagttccgccaagggcgaagagctgaaaaatgccatgactcgccgtggcgtaaaaggcttggagttctggcacaacgggatgaagcagatctctgccaacaagccaattttggtgcctgcggatgccaaagggttgaaattccgtgtacaagcgtccgatgtgttggtggctcagtttgagcagatcggtgctaacccacagaaaatgtcgtttgcggaaacctacggcggtttacagaccaaagtcattgatggacaagaaaatacttggtcaaacatctacggacaaaagtactttgaagtacaagatggcaccaccgaaaccaaccacggcattctggattacctcgtggtgacctcaagtaaatggtgggatggcttacctgcagatgttcgtgatcagtttgccaagatcctcaatgaagtcacgattgagcgcaacgcagaatccaacaaagtggaagagctcaataagcagtacatcattgaagcgggcggtgtcgtacgcactctgactccagagcagcgtcagcaatgggtcgatgcactcaaaccggtatggcagaagtttgagaaagacatcggtgccgatctgattgaagccgctctggcagctaaccagaagtaacctttatttggccccatcacggtggggccgtttgtctgttcgtcacactattagagcgatgtatcacatggaacagtcatggttttcgagagtcggccagtttaccgactcgattgaagaatttctgatcgcattttttatgggcgcgatgacgctactgacctttgcaaacgtcatcatgcgttatctattcaacgacaacattctctgggcgcttgagggaacagtatttatgttcgcttggatggtgcttgtcggggcgtcatttggggtaaaacgccactttcatattggtgtcgatgtgctgatcaatatcgcaccagcacgattgcgtaagctgtatgcattggttgctgtggcctgctgtttggcattttcaatcctcttactgatcggttcttggaactactggcatccctttattactgaacgtgcttggtacgaaaccgacgatattcctatgcctgatatgctgcagttcctcgctgattgggttaacgaaggcgagcgttatgaaaagctgccacgtttcattccttatgccgctctaccgattggcatggcattactgactttccgatttttacaaatcgcttggcaaatcatcactggcaagctggatcgcatgattgctggacatgaagcagaagaagacttggaagcgctgaaagcagagctttcagaagcgggtgaggcaatgatgcctaagactcaaggcaaggagaagtaagccatggccgttgcactgttatttattctggttatcggcatgatgattgttggcgtgccgattgctatctcgctgggcttgtccagtattttgttcctattgtggcactcggatgcttctttagcttcggttgctcaaaccctgtttaacgcgtttgctggtcactacactttattggcgatcccgttttttattctcgcctcaacgtttatgtctactggcggtgtggctaaacggatcatccgttttgcgattgctatggttggctggttccgcggcggtttagcgattgcttctgtggtcgcgtgcatgatgtttgcggcgctctcgggctcatctccggcaacggtggttgccatcggcagtatcgtgattgcgggcatggtcaaaaacggctacagcaaagagtttgcggcgggggtgatttgtaacgcaggaaccttgggtattttgatccccccttcgattgtgatggtggtgtactcagcggcgaccaacgtttcggttggccgcatgttcttaggtggtgttgtcccaggcttattggctggtctaatgttgatcatcgcgatttacattaccgcgcggataaaaaatctacccaagcagccctttgttggctggaaagaagcgctgaaagcagccaaagaagcaagctggggcttattgctggtggtgattattctcggtgggatctacggagggatctttaccccaacagaagcggcagctgtggcggcggtgtactccttttttatcgccaacttcatctatcgtgatatggggccgtttgcggataagaccaataccaaaccggtactagtcaaagtagtggaaacctttgtccacaaagacaccaaagcgaccttgtatgatgcaggtaagctgaccatcatgctgatgttcatcattgctaacgcgcttatcttaaaacatgtactcaccgaagagcgcatcccgcagatgatcactgaatccatgctgtctgctgggcttgggccaattaccttcttgattgttgtgaacctgatcttgttggtgggtggtcagtttatggagccatcgggtcttctggttatcgtcgctcccttggtattcccgattgcgattgcactgggcatcgaccctatccatctcggcatcatgatggtggtgaacatggagattggcatgatcacgccgcccgtcggcttaaacctgtttgtgacctctggggtagccaagatgtcgatgatgaatgtggttaaagctgcactgccgtgggtgggcgtcatgttcctcttcctcattattgtcacttatgtgccttgggtatccacttggttaccgacgctcttgatggggccggaaatcatcactcgctagcgcttaacgcttaagtttgcaaataacgacaagcccttcgcatgcgaagggcttggtttttttatgccgacctttaatctgagacctagacttttaaccagaacgcgggatggtttcagggtttgtaactctctttatcgagctgatatttctgcattttgtcatacaaggttttacgtggaaggtggagacgctccatggtggctttaatgctgccaccacactcaatcagcgtctgctccaaaagtgatttctcaaactccgcgacttgttcattcagtccgagtaatttggattttggctcatggctttcagcaaattgcgccaacttaccgagtaacacatagcgttctgcggcattacgcaattcccgcacgttgcccggccaatcgtgactaagcaagctttgcacatcggaggccgtcagtgctgtagccgctttaccataacgtgcggcagcgaccagtaagaaatggtggaaaagggcaggaatgtcctctctgcgctcacgcagcggtgggatcgttaaggtgacaatgttgagccgatagtagagatcttgccgaaatttcccttcggcagcggcttgttttaaatcgattttagtggcggcaatcacccgaatatcaaggggaatgagttcattcgagccaatccgttcgatcactcgctcttgcagcacacgcagcagccggatctgcgcttgcatcggcatcgattcaatctcatctaaaaacagagtgccaccttgagcatgctcaaacttacccactcgacggctgtctgcccccgtaaacgcgcctttttcatggccgtagagctcgctctcaatcaagttctccggcaccgcaccacagttaatcgcaacaaaattctgttcacggcgcgagctctgttcatgcagtgaacgggcaaccaactccttgccggttcctgtttcaccaaacaataaaatatccgcttgggtatccgcgacttgggcaatggtatcgcgcagagtttgaatggcggcggtttcaccaataattcgcgggcctaaggtttggctgacttttaaactgcgttttagctgacggttctccaaagtaaggcgacgtttttcgatggcacggtgtaccgtgtcaatcaacctctcaggcgcgaagggcttttcaataaaatcgtaagcaccatcatgcatggctttgaccgccatcgaaatatcgccatgtccagtgataagaatgacaggcagttcactgtcttgatgtaatacggagctcagtaaattctgtccacttaaaccgggtaagcagatatcactgacgatcaccaatgggagtccttgcgccttgattgccagcagtgcctcttcgacactggcaaaaaactgcgcgttgaggtctgccaattcgaaactttgagcgagcgcaatgcggatatcgctctcatcatcaatcaaaaatacatcacacatggttagtccatattgagaggtgtgaaacgaggcagggtgatggtaaagcgcgctccaccgagtggtgaagtcgccacgctcaatgttccttgcatgctgtgcaaaatttgctgtgaaatagaaagtccaagccctaaaccattctttttcgtggtgtggaagggttcaaacagatggggcaaggtttcaatgccgacaccgggaccattatcatcaacgaaaagcgctatttgctgttcagaggtttgcaaacggatttgaactacgcgctccgcttgtccctctaacgcttgcagtgcattggtgagcagattaatcagcacttgttctaactggatgggattgacgcgtacccaaacgggcgtttcgaggtcgcacagctctaacaacgtcatctgcgctttaaattgcccagtcatcaactctttggccgacaaaatcaacgggtacaactgcacgtcttgctgctcattggaagtggattttcgggcgaaagatttaagctgctcactgattttcgccatgcgctccgtcagtgcggaaatacgcgagagattttcttcagcgcgttcaggcttattggtggcaaggaaacggcggccgttatcggcaaaactgcggatcgccgccagcggattgttcagctcgtggctaatactggccgacatttggccgagcactgccagtttcgccgcttggatcagctcatcttgtgtttggcgcagcgcgtgctcggttttgatccgttcagcaatttccgcatgcaatttggcggtgcgctccatcacctcaaattcaagcttctgcttggtctcttgctgcagttgctcgatttgccgctgacgcagctgccggtgatgccacagttgaaaacccaaatacacaatcgcaaacaacatgcagagaataatcactaagccaaacgccgaccaaaagagttcgattttcggtgaaagcacgcgaatggtcagggcaagttcaggaagcgggcgactcgaaacaatgtagtcatcttgcagccaatgtttttcaggcttgcgccattcgctttgctccgcttgcaagtcgccctgccagccgagggaaggaatagggctgtctaaatattgctggctttggcgaatgtcgttgagctgtgcgggagataaatctgcaacgctatgaaacagccaagcaggttggctcgacataaacaccacttgatgatcatcagtcgccacaaaatagctgctcttgctttgccagccctgctcaatggccgacaaatccattttgaccacgataacccctaagatttccgccgcataaatcactggataagcgtaatagtagccgcgttgtcctgaggttgaccccagcgcaaaatattggcttttttgacccgcaatggagaggtaaaaataaggtcgccatgcaaagttgcgtccgataaaagagcgatccaaattccagttactggatgcgatcgtgttgccaaagcggtcgatcaaataggtatctgcggcttggatgacttcattgacttgctctaaatagcgattggtgatgtcgatttgcgccgaattttgtgccgagagcagtgcatccaccaactctttatctttagaaatcagatggggaatgtgggcgtatttatctaaagtcgcaacgatatggcttgaaaaacgatcaagctgcgactgatgctcattgagcagcgcttgatactggaaacgccagtataagtgcgtgctcatgctcaccagcacaataaacatgacccacaacatcaagctgagacgacgaatggatggcatccttggctcttatcaacaaatcctttcgttacatcatactgagaatgcacagccgaagcgtctaaaaagatcgcaatctcggtctgcaaaacaagagcaagatctctttttacgcttttcaataaaaaaaagcctcgattccattgaaaaagcctatattgtccccatttcagagtcgctatcggtttccttttggtggaatttttagcacttgattgggttttcaggagattggcttgactctgaccggggattaactcgacagctccggctgtggtcgttagaatgtcgcgtctgaaatttggtcctgagactaatcggagatacctttgccaaaagatatcgctcattagtctggttttctggtgattcgcttgaaagccgatgctcaatatttacatatcagtgttcaatcgggcacaacacaaggatgcagccacacgtcgtgttggctcatgacgctcaggaaccctgagccagttttgaggtttagaaataatgcaagttactgttgaaacgctagaaggcctacagcgccgtctgaatattactgttccagctgcaaacatcgaagacgctgtagcagctgaattacgcaacatcgcgaaaaaccgtcgtttcgatggtttccgtaaaggcaaagtgccaatgaagatggttgcgaaaatgtacggcaaagcagtacgtcaagacgtgctgggtgaagtgatgcaacgccacttcatcgaagcgatcgtaaaagagaaaatcaatccagctggcgcaccaacgtttgctccagttgaaattggcgaaggcaaagatctggttttcacagcaacatttgaagtttacccagaagttgaactgaaaggcctagaaaacatcgcagtagagaagccagcagcagaagtgactgacgctgacgtagcagaaatgctggaaactctgcgcaagcaacaagcgacttggaaagaagttgacgaagcggcagaaaacggcaaacgcgtttctatcgatttcgtaggttctatcgatggcgtagagtttgaaggcggtaaagcagaaaacttccctctggaaatgggcgcaggccgcatgatcccaggttttgaagacggtatcgttggcaaaaccaagggcatggaattcgttatcgacgtgactttcccagaagattaccacgctgaaaacctgaaaggtaaagcggctaagtttgctatcaaagtgaacaaagtagaagcgcgtgaactgccagaattgaacgatgagttcgttgcacgttttggcgtagctgaaggcggcgttgacgctctgaaagcagaagtacgtaagaacatggaacgcgaactgaagcaagcgatcaaagcgcgcatcaaagagcaagcgattgaaggtctggtaaaagagaacgaaatccaagttccttctgcactgatcgatcaagagatcaacgttctgcgtcagcaagctgcacaacgtttcggtggcaatgttgaagctgcggctcaactgcctcgtgaactgttcgaagagcaagcgaaacgtcgcgtagtggtaggtctgctgctgggtgaagtgatccgtactcacgagctgaaagcggacgaagaaaaagtgaaagcactgatcactgaaatggcgactgcgtatgaagatccatcagaagtggtttcttactacgagcaaaaccaacagctgatgaacaacatgcgtaacgttgctcttgaagagcaagcggtagacgcgatcattgcgaaagcaaaagtaactgaaaaagcgatcagcttcagcgagctgatgaacccagttgctgcttaataagcaaactgtagcgtagaaggttgacgaaacaagcaatcatctgctaacaatggtccgtgtgatacccatcatccgggccatttattttagggatataagactatgagctaccaagaaaaaaatgcaatgtcgcccatttttgacgcactcgtacctatggtggttgaacaaacctctcgtggtgagcgttcatacgacatctattctcgcttactaaaagaacgagtgattttcttaaccgggcaagtagaagatcacatggcaaaccttgtcgtggctcaactgcttttcttagaatctgaaaaccctgataaagatattttcctttacatcaactcacccggtggcagtgtcactgcagggatgtcgatttacgatactatgcagttcatcaagccaaacgtgagcacagtgtgtatgggacaagcctgttcaatgggcgctttcttgcttgctggtggtgcaccgggcaagcgttatgtactgccgaattctcgtgtcatgattcaccaaccactgggtggattccaaggccaagcctctgatattcaaattcatgctcaagaaattctgaccattaaaaacaaactgaaccgtttgttggcagagcatacaggccagccaatcgaagtgattgaacgcgatactgatcgtgataacttcatgtcggcagatcaagcagtggaatacggtttggtggatgcggtgctgaaacaccgtggcgagtaagctcgtaattgtataacgcaattttgattgaattgttatacactcaaaccaaagtgagtaaaggctaagaggttagcgaatgacagacaaaagcaaagagggcggtagtagtaaactgctgtactgctctttctgtggcaaaagccagcacgaagttcgcaaactgatcgcaggtccgtccgtgtatatttgtgatgagtgcgttgatttatgcaacgacatcatccgcgaagagatcaaagatgttctgccaaaaaaggaatcagcggcgttaccgacgccaagaaagattcgtgaacatctcgacgattatgtgattggtcaagaacacgccaaaaaagtgctagccgttgcggtatataaccactacaagcgtttacgtaatggtgatacgactagcgaaggcgttgagctgggcaagagtaacattttgctgattggcccaacgggtagcggtaaaacactactggctgaaacgctggcgcgtttgctggatgtgccatttaccatggcggatgcgaccacattaaccgaagcgggttatgtgggcgaagatgtagaaaatatcattcaaaagctgctgcaaaaatgcgattacgatgttgcaaaagcggagcgtggtatcgtctatatcgatgaaattgacaaaatttctcgtaagtctgaaaacccatccatcacacgtgacgtgtcgggtgaaggggttcagcaagcgctgttaaaactgattgaaggtacagttgcttcggttccaccacaaggtggccgtaaacatcctcagcaggaattcctgcaagtcgacacctcaaaaatcctatttatctgtggtggcgcgtttgctggcctagataaagtgattgaacagcgtgttgcgacagggactggtatcggttttggcgcggatgtgcgttctaaagacaacagcaaaaccttgagcgaactgtttactcaggttgaacctgaagatttggtgaaatacggtttgatcccagagttcattggtcgtctgcctgttacggcaacgctgactgaactggatgaagcggcattgattcaaattctgtgtgaaccaaagaatgcactgaccaaacagtatgcggcgttgtttgaactggaaaacgttgatctggagtttcgtgaagatgcgctgaaagcgattgccgctaaagcgatgaagcgtaaaaccggtgcgcgtggtctacgttcaatccttgaagcagttctactggaaaccatgtatgaactgccttcaatggaagaggtcagcaaggtggtgattgacgaatctgtgatcaacggagagtccgcaccgctactgatttacagcgctaatgagagccaagccgctggtgcggagtaatctcaagcaacaaaaaataacgaggaggtattcaatacctccttttttttattctgtcattgaatccagttagttagcccccatatactgcgtaacaaatgcaaagcggaagagagaaaaatatgaacttggagcgttccgagcgtatcgagatccccgtactacccctgcgcgacgtggttgtctatccacacatggtcattcctttgtttgttggccgagaaaaatcgatccagtgcctagaagcggcgatggataacaacaagcaagtgttattggtggcgcaaaagaaagcggaaaccgatgagccgaaagtcgccgacttatttgaagtcggtaccgtcgcaaccatcttacagttgctgaaattgcctgatggcacagtgaaagtactggtcgaaggtcaacagcgtgccaaaatcactcaattctatgaagaagagtatttctttgccgatgcacaatatctggtgacaccagaattggatgagcgtgagcaagaagtggtggttcgcagtgcgattaaccagtttgaaggctttatcaaactcaacaaaaaaatcccgcctgaggtactcacttcactgaacgggattgatgaggccgcacgtttagcagacacgattgccgcgcacatgccgctgaaattggtcgataaacagaaagtgcttgaactgctggatgtcagtgaacgtttagaattcttaatggggcagatggagtctgaaatcgatctgctgcaggttgagaagcgcatccgcacccgcgttaaaaagcagatggaaaagtcacagcgcgagtactatctgaatgaacagatgaaagcgattcagaaagaattaggcgagatggatgacgcgcctgacgaatttgaaacgctgaaaaagaaaatcgaagagtcgaagatgccgaaagaggcacgcgacaaagcagagcaagagctgcacaagctgaaaatgatgtcgccgatgtcagcagaagcaacggtagtgcgtagctacatcgattggatggtcaatgttccgtggactaagcgcagcaaggtgaaaaaagatctctctaaagcagaagagatcctcaatgctgaccactacggcttagagcgggtcaaagagcgtattttggaatatctcgccgtgcaaagtcgtatcaataagcttaaaggtccaatcctatgcttagtggggcctccgggtgtgggtaaaacctcactgggtcgctcgattgccgctgcgactgggcgtcagtatgtgcgtatggcgctggggggcgtgcgtgatgaagcggaaattcgtggtcaccgccgcacctacattggctctatgccgggtaagcttattcaaaagatggcgaaagtcggggtgaaaaacccactcttcttactcgatgaaatcgacaagatgtcatcggatatgcgtggtgatccggcttctgcactgctagaggtgcttgaccctgagcaaaacaactcgtttaacgatcactacctagaagtggattatgacctgtcggacgtgatgttcgttgcgacttcaaactcgatgaacattccaggcccattactagaccgtatggaagtgattcgtttatcggggtacaccgaagatgaaaaactcaatattgccaaagaccatctggtcagtaagcaagttgagcgtaacggcctcaagccaagcgagatcgtgattgaagattctgcgattgtcggcattattcgctattacactcgtgaagcgggcgtgcgtggtctggagcgcgaaatctcaaagatctgtcgtaaagccgtgaagaaaattctgctcgataaaggcgtgaaaaccgttgttgtaaaccaacaaaacttaaaagagtttttaggtgtacaacgctttgactacggtaaagcggaagagagcaaccgtattggtcaagtgaatggcctcgcgtggacggaagtgggcggtgatttactaaccatcgaaacccaatcgatgccgggtaaaggtaaacttacccaaaccggttcactgggcgatgtgatgcaagagtcgattcaagcggcgatgacggtggtgcgctctcgtgcagaaaaattgggcatcaaccctgatttctatgagaaaaaagatatccatgtccatgtcccagaaggtgcgacacctaaagatggcccaagtgcgggtatcgccatgtgtacagcgctggtttctagtttgaccggtaacccagtcaaagcggaagtcgccatgaccggtgaaatcactctgcgtggtgaagtattaccgattggtggtttgaaagagaaactgctggcagcacatcgcggtggcatcaaaacggtgctgatcccgaaagataatgagcgcgatctggaggagatcccagataacgtgatcgccgatctgcaagtacttccagtgcagtggattgacgaggtgctcaaagttgccttggagcaagacccgacaggggttagctttgagagcaaaaagagtgatgcatagcaaaaataagtaaatctttacgctgataggtctaaaaaggcttgtcagcgttttttttgaaggctaacgttactgtcaatagcttctagccctgatgcaacaaggctttaggctagttttaaactttaatggaacgaaatcggcaccgataaaataataaagggtgaccaaaggggaatcacatttgaatgaagattttgcacttttctgcaaaataaattcgaaccttttgaaattatgcgcatcctactgatgcgcatttctttttctgatattatcgcgccattcattttgggcttacgtgcctgatatcaaccccggagagtagtagcactatgatggatcgattacgcgaaggcgtgaacagcatcgcggttaaaattatccttggattaatcatcctgtctttcatttttgctggtgtaggtaactacctgatcagcggcggtaataacgcggccgctaaagtcggcaatgcggaaatcagtcgtggtgattttgagcaagcctatcaaaacgaacgtaaccgtatgcaagctcaactgggcgattatttttcaaacttgctggcggatccgacctatgtcgcctctttccgtaagtcagtattagatcgtatggtgaacgatttgctcttagagcaacatgcagcgtcactagggctacgtgtgagtgatgagcaagttcgtcaattgattttagaaatcccacaatttcaatctcaaggcgtatttgactctacggcttaccaagcgactctgcgtcgcgcaggctttactcctgagatgtatgctgaatacttacgcaaagatttagtgcgtaatcaattgatgagtgcattgcagggaagtgaattcagccttgctggtgaagtaaacttgcaagaccaattgatttctcagacgcgtgatattcgtacgatcaccttatctctagaagacttcgcaaaaaaagtgacgttgagcgatgaagagatcgatcagtactacaaaactaacaccgagcgttttactcgccctgagcaggtaaaagtctcttatgtcgagctctctgctgatggactgaaagcgcaagtgagcgttgatgatgcggcagcgcagcagtactaccaagaacatttggataagtactctactgcagagcagcgcaatgtgagccatatcctgattgaaggtaatgatgagcaaaaagcacaagcgattttggatgaactgaatgctggtgctgattttgcgactttagcgaaagaaaaatcgcaagatctcggcagtgcagcagagggcggctcactgggttggattgaacctgacactatggacccagctttcgaagcggcagcatttgcattaactgaaaagggtcaagtttcgggtcttgtaaagtctgatttcggttatcacatcattcgcttagacgacatcaaagcacctgtggtgaagccatacagtgaagttgagcaggcgatcaaacaagaactgattgatcagcaagcccttgatagtttctatgctaagcagagtgaacttgaaaagatggcatttgaacattcagactctctggatgaagcggccaaggctatctcagctacggttgtgcacaccgattttatctctgccgaacaagctcctgaggtgttaaccactcctgcggtactgcaagcgctgaaatcaccagaagtgaaagaagatggtctcaactctgaagtgattgaagtagctccagagcatgtcgtggtggtgcgtgttgaagagtttcgtccagaaactgtgctgccacttgatgaagtcaaatcgcaagtggttgagcagctatctcgtatgaaaggtgaacaacaagcacttgaactgggtaaccagcttgtgactgcgttgaaagcgggtgaaacggatctgctagcgcaaaaaggtgtgtcttttggcgaattacaaatgatcgatcgcagttcacctcttgccaacacggtttacgccatggtgaaaccacaagagggcgagaaggtttatgcccaagcgaaagattttgacggcaatatcgttgtgattgagttgagcaaagtggaaagtaaactgacaccggcttatcacgaacagatcgctacacagttagaacgtatcggttctcagcaagatctggcgggtgtgatcagtgtgttgcgtcaaaacaccgatattgagtatcacattgcgacagaataagcattcttagtgtaattgatatgtttaaagaaacgggctacagcagtagcccgttctatttataaattgtcgaaatttccatcatttttcccctcgctatcataagccctcaacaaccaaaatgagggtctatcatgcaaatcaaaaccaaaatagtgacactgtttctttctctctgcctgccgacattaccgttactggccaatgccgaggaaacggcacccgctgcgcaggtagaagaaggtattgtgatcactgtcaatattaataccgcttctgcagaagagctggcgacgttactcaaaggcatcgggcttaagaaagctcaggccattgtcgattatcgagaagccaacggtccttttactcatatcgatgatctgacgaatgtgaaagggattggtgaagcgacagtgcgcaacaatgccgcaaggatcttgttataagctgcaatcatgtgtctcgtaataactcggcttcggccgagttaattttttaactcagtagcctttttatggttaatcaggactcttacctagcaccagagagcctttgcacttataattcttcgccgaaaacgcgggcgtgacgattccaatcgcctaaaaacaaaaaagtggagaaatacatgtcttctcatacgccagtggttaccgttgatggacctagcggtgcaggtaaaggcacattgtgcatgttgttggctaaaaaactcggttttcagctattggactctggcgcgatttatcgcgtgttggccttggcggctcttcatcatggcgttgatcttgaatcggaagacgctttggttcctcttgctacgcatcttgatgtgcagttcatcgcggaaggcgacttagtgaaagtcatcctcgaaggtgaagatgtgtcccgcgagctgcgtaaagaagaaactgggatggctgcgtcaaaagtcgcggcattacctcgggtacgtgaagcgctgctgcgccgtcaacgcgcgtttgctagtggtattggattagttgcagatggccgtgatatgggcacagtggtttttccagcggcggaagcaaaaattttccttgatgcgagtgcggaagaaagagcccgtagacgcttcaagcagttgcaactgaaggggcttgatgttaaatttgatgcccttttaagcgaaattcaggaaagagacgaccgcgacagaaatcgtgctgttgctccattacgtcctgctgaagacgcattagtgcttgattcaaccacattgactatcgatgaagtggtggaacaagcgctacaatatattgaatctaagctagtgtgaatggttcacgctaggtaagaacgtcggtcgcaaggatgatgactggcgaatttaataaccccacgtggtaggacacccgtggccgtttaattattgaagattaaataaatgactgaatcttttgctcaactctttgaagagtttctgaacgagacccaattccaacaaggtactatcgttaaaggtactgtagtagcaatcgagaacggctacgttctggttgatgctggcctgaagtctgagtctgctatccctgctgaacaattcaagaacgctgctggcgaactagaagttcaagtaggttctcaagtagacgtagctctggacgcggttgaagatggtttcggcgaaactcaactttctcgtgagaaagcgaagcgccatgaagcttggatcgtacttgaaaaagcttacgaagaagctgcaactgttatcggtatcattaacggtaaagttaaaggcggtttcactgttgaactgaacggtatccgtgcgttcctgccaggttctctggttgacgtacgtccaatccgtgacactgctcacctagaaaacaaagagctagagttcaaagttatcaagctagaccagaagcgtaacaacgttgttgtttctcgtcgtgcagttatcgaatctgaaagcagcgtagagcgtgatgaactgcttgaaactctgcaagaaggtactgaagttaaaggtatcgttaagaacctgactgactacggtgcgttcgttgatctgggcggcgttgacggtctgctacacatcactgacatggcttggaagcgcgttaagcatccatcagaaatcgttaacgttggtgacgagatcctagttaaagtactgaagttcgatcgtgatcgtactcgcgtatctctaggtctgaaacagctaggcgaagatccatgggtagcaatcgctaagcgttacccagaaggtcacaaactgtctggccgtgtaactaacctgactgactacggctgcttcgttgaaatcgaagaaggcgttgaaggtctagtacacgtttctgaaatggactggacgaacaagaacatccacccatctaaagttgttaatgttggcgacgaagttgaggttatggttctggatatcgacgaagagcgtcgtcgtatctctctaggcctgaaacagtgtaaagctaacccatggcaatcattcgctgaagcgcaagctaaaggcgacaaagtaactggtaagatcaagtctatcactgactttggtatcttcatcggtctagaaggcggtatcgacggtctggttcacctgtctgacatctcttggaacgtaccaggagaagaagctgttcgtgaattcaagaaaggcgacgaaatctctgcagttgttctagcagtagacgctgagcgtgagcgtatttctctgggcatcaagcaaatggaaaacgatccattcaacgcttatgtttcagacaacaagaaaggtgctctggttaacggtactgtaactgcagttgacgcgaaaggcgcaaccatcgagctagaagacggcgttgaaggttacatccgcgcttctgaagtatcacgtgaccgtatcgaagatgcatcactgatcctgaacgttggtgacaaagttgaagcgaaatttactggtgttgaccgtaaaaaccgcgtaatcaacctgtctatcaaagcgaaagatgaagctgaagagcaagaagtaatggcaactctgaacaagcaagatgaagctgcgttcggtaatgctatggctgacgctttcaaagcagcgaaaggcgaataatagccaaacgctaatagacaaaaggagccgcaaggctccttttttgttgtcatccctaaaccaccgcttttgcggtggtgcttgttgtaatcttatgatcgccacctaagattaaacatgagtagttgccaaaaagccgcataacgttcactcttagaaataaaacagtaaacctaatgtaagatctcgcccaacgtcgagttctttttctacaatgtaaatcaagtgtttgttggaattgatattactgactataattgagcagtaacaactcgaagagggaaactatgactaagtccgaactgatagaaagactctgtgccgaacaaacgcacttgtctgcgaaagagatcgaagatgcggtaaaaaatatccttgagcatatggcctcaacgttagaagcgggggagcgcatcgagattcgtggtttcggtagcttttccttacactatcgtgagccgcgtgtagggcgtaatcctaagactggcgataaggtggagttggaaggtaagtacgttccgcatttcaaaccaggtaaggaactacgcgaacgcgttaacttgtaatctgagtaaagtttgttcacacgagcggcatgctaatccagcgtgccgcttttttatatcagcatgactattagccgtggtttgtcgcgccgttttcctgcataatcggtgtgccaatttgtgaaaaggtaatgacttatgaaaattataaagatagtcgccgtactcgctcttttcttaatcgcattagcattaggctcgcaaaaccaatcggttgtggtatttaactacttgctagcgcaaggtgagtttcatttatcgaccttactgggtacggtttttattgtcggctttgcttgtgcagcgattcttttcggtggcatgcatttcaagtcgcaactgagaattcgcaaacttaccaaacagttaaaattggccaatcagcaatccgcacctgaaacgaaagtacatagcggataaggctgttttcgatgttagaaatactgttcctgttattgcccatcgctgccgcctacggctggtacatggggcatcgtagcgcccagcaagataaacagaaacaatcacaccaaatttcgcgtcaatacgtgaccggtttgaacctcttactctccgatcaatcggataaagcggttgatcactttatcgaattactgcaagtcgataatgaaaccattgatacccatctagcactcggtaaccttttccggtctcgtggcgaagtggatcgcgctattcgtattcaccaaaaccttatctctcgctctgggttgaccatagaccagaaaaacttggcgctgcagcagttagctaaggactatatggtgtccggttttcttgatcgtgctgagaaaatatttgaacaactgattgatgagcctgagcatcgtgaatctgctctccagcagctcacggcaatttatcaacagactcgtgagtggcacaaagcgattgagtgtgccaccgctttggttaagcttgggcgcaaacgtatgaaggtgaacattgcgcatttctactgcgagctggccatgcttgaaaaggcggacagtaacgataacaaagccattcaactgtttaaaaaagcattacaagaagatccgaaatgtgtacgtgcaaccatttcactcggtaaactctacctacaaaacgaagactatcagaagactattgaccatctagagatggttcttgagcaagatatcgattttatcggtgaagtgctcaatacgttggctgagtgttaccaccatttggggcgagagcaagatttgatcaccttcttacgtcgctgtatcgccaataaagcgggggtatcggccgaattaatgctcgctcagctggttgcacagcatgaaggtattgccgctgcacaagagattttaactcgtcagttggttaaaaatcctactatgaaaggcttttaccggttgattgattaccatattgccgaagcggaagagggcagagccaaagccagtctctctacgttacaacgcttagtgggtgaacagcttaaagtaaaaccccattaccgttgccgtaaatgtggcttttcgacccattcactttattggcattgcccatcatgtaaaaactggggttcaatcaagccaatcagaggcttagatggtgagtaattaaaaatcaacagtatgacgcagctatttatggctgcttttttttaactcgatatacagataggagaaacgatgaacgacccaaaagtgattgttgcactggactatgacaatctggcggatgcgctcgcgtttgtggacaaaattgacccaagcacatgtcgactcaaagtgggtaaagagatgtttactctatttggtcctgattttgtccgtgagctgcataaacgaggtttttctgtgtttctggatcttaaatttcacgatattccgaatacctgttcaaaagcggtgaaagctgccgctgagcttggggtttggatggtgaatgtgcacgcgagtggtggcgagcgaatgatggcagcatcgcgtgagattctggagccgtatggtaaagagcgcccactgctgattggtgtcactgtattgaccagtatggaatctgccgatttacaaggtattggcatcttgagtgcgccacaagatcatgtgctgcgattagcaacgctcaccaaaaatgctggtcttgatggtgtggtatgctccgcacaagaggcatcactattgaagcaacatttggggcgtgaattcaaattggtgacgccaggaattcgtccagcgggttcagagcaaggcgatcaacgccgtattatgactccagcccaagccattgcctctggttcagattatctcgtgatcggtcgccctatcactcaagccgcacatcctgaagtggttctggaagagataaacagctctttagtttagctttactagattggataaactcaagcccagtcacagtactgggcttttttaaaaaggctatttaggaataccactgtgaaacttgaaatcgctatcgggagtggaaattaactccgcttcgactcggccaaaatacgcaacacgttcagagatatcgtagcccgcaatttgttcagccagttgcaagtagtcttgataatggcgagcttcagagcgaagcagagaaacataaaattttgctatctcgtcatctaagtagggggcgagtttggcaaagcgctcacaagagcgagcctcaatataagcgcctactatcagcttatcaatcaatgtctgtggttcatgagtcttcatatgggctagaaggcttttggcataacggctagccggaattgactcatactccacattgcgcgcttgcataatttccaacacttgatagaaatggtgtagctcttccttgattagcaataccattttatcgatcaaatcttggctataaggagaatccgatttggcaatgatcgctttggagatttggcttttgcctttgagcgattggatatctccaattttgcgatacgcaaagtcttcataaggtttaaaccaatccaatagcgaaagttcactctctttatcaaccgcatacttacggatcagaaacatggcggattgaccagctttcagctcacatagtaaatggtctaacaacaaaacacgtaggttttcaggtttgcgcgcttcttcaacccattcgtcgggtgtaggacattgcaggaaatggttaatcggttctaaaagttgttggatagcagatggatgaatcatgggcactatttaagaaaaaggccacataagcggcctgaagttaatcaagtcattatcgtgcggtatcttaccactttttcttctcgccaaagagcacatccatgtcacttttgcgttcattttcttcaatttgttggaggtcagaagcacttttgttttgacgtttctgctcaagttcatcatacatagtctgtaacttttcacgggcttgatttgagtagctgtcattttttgaggacaaaacatcaatccctttacgtagtagctggattgcagtgccgggttgcccacgcaaaatcgagtcgttgacgcgcttaatcacgttttcgatgttgattcgaatctgaatggtctctaagcgagcattttctgccacataggcttgggtttcaaaacgtcctttattgtgctcactgcgaatagtgtcacgcagacgtttaaccagctttagcatgatgatggcttgtttatcgctgctaggaaccttaaatgaagtactttcaccacccggatggttattttgcaggtggttgatctgtcccttcatattttcgatacgttgagcgagttgcttatttttaggatcaaggtcatacatgctttgtagtgcatcaagaatacggttattcaagcagactaaaagctctttactgaatggcagatggtgagcattgccgattaaatcttcagttgcatcaataatggccacatagcgcgaggattcctgtttcttggcgctttcgactttcacccgatattgcaacatgatgttgtagccaagaaccaaaatgagcaaaatggccaccagagcaatgattaaacctatattcataaaatccgtatcttcagttttcaatggctaacgattaaggatacacgctcgttgtgatcccgacaatttactctgttgattattcccgttttatcatgcaaaaaccgctttcccacgatgagtttgagcgttgcgtggcaattttttcaccgaataagcaaggcgctgaatattcatttcacgcttctctcgataaaggctaggaattgtcgcgctgaagcgttataactaataattataaaatatgtgtgtctgtggcaaaacaccgcaagggattatgggaaaaagatgaaactgcagcagttaaagtacattgtggaagtggtcaatcataatttgaatgtgtctgcgaccgcggaaaacctatatacctctcagcctgggatcagtaaacaggtcaggctgttagaagatgagcttggaattcaaatttttgagcgaagcggcaagcatttaacgcaagtaacgcctgcgggcgagcacatagtgcgtattgcgacggaaattttatcgcgcgtcgaaagcatcaaggcggttgctgccgagcatacgcatccagaaatgggcacgctgaatatttccactacccatacccaagcccgctatgctctgccagaggtgattaaaggttttactaagcgttatccaagagtttccttgcacatgcatcaaggcacgccaactcaaatgtcggaagcgatagccaaaggcactgcaaattttgcgattgcgacagaagctttgcatttgtaccaagatgcgatcatgttgccttgttatcactggaatcgttcgatagttgtgcctaaagatcacccgctgaccaagaaagagcaggtgactatagaagatttagcggcttacccattagtgacctatgtttttggctttactggacgttcagagcttgatagtgcgttcaatcgagttggcatgacacctaaagtggtctttaccgccaccgatgcggatgtgatcaaaacgtatgtgcgcatgggtattggggtgggtgtgattgctagtatggcggtagacaaaaagcaagatacggatctggtggcgattgatgcaagccatatcttcagtgcgagtaccaccagtattggttttcgccgtggtactttcctgcgctcttatatgtttgattttatggagcgctttgctccacatcttacccgtcccgtagtagagcaagccatctctttgaaatcgaatattgaaatagcagaaatgtttaaggacattgatctgcctgtgcgttaacgcgcttttactttcacttcattgtgcttcctcctagaatggctcaccgataggaggaagcatgcaagctctattcatacaactcgattcattcttaactcaaacccaatctttttggcgttatgaggcttttcatgcttgccgtttatcggcgttgccttggggggatgcgtatcccgagttaaccgcttggctctatgctcttagtcaggatgaggtcgtggagttcaaaaccgatccagagaaactctcttccgtcttatctggttttttttccggattagaggagatgaaactcccagtcgacatttcagactcttccttgctttcactccgattaccaaagttttttgacaaagggatccccggacgtaaatggcaacaaatagaagcgatcagtaaagtgcttgttgcgcaccatcaaggcactcagtggttagagtggtgtgctgggaaaggttacttggggcgtattttggcgggtgtgactcagcaaccagtcgtcagttttgagtatcaagccgagctttgctgctctggacaacaagaagccgatgcgttgcaactccctatgcagtttgtgcagggggatgcatttgatgagcgttctgctgccctgtttaactccagtactcatgctgttgctttacatgcgtgtggtgacttacacgcaaagatgcttcattacgccacctcttcgcatgccgcggcgattagcttttctccctgctgctaccatttgattcgagataacgaatatcacgcgatgtcgaaagtggcggctcagtcagatttgcaattgacccgtcgagaactgcgacttccactgcaagaaaccgtgaccggaggggaaagggttagacggcagcgacagcaagagatggtttatcggttaggatttgatgctctggtgagtcaagtcggccatcaagcgggttatatacctatccctagtattcagaaatcaaaactcaaccaagggtttgccgagttttgccagtgggcggctcaagagaaaaatatcgctatggatttcactcacgtcgatttggctcattttgaaagtttaggctatcagagattctggcagatggaacggataagtttagttcaagacgggtttcggcggctgctagagctatggttggtgttggataaagcgctctatttgcaggagcagggctatcaagtcagggtgagtgagttttgcgatcgtaaagcaacaccgcgcaatttagtggtcaatgcttggcgctgaattgaagaggggagagccgataatatcggctctctgaatcattaattaaacatcgcaatcgctttagcggggtcgacataatcgaggccaaagttttctgcaacctctttgtaagtcacttttccgtgaattacgttgaggccttttaaaaatcctgcatcttctagtagggctttttggtagcctttattggcgagtttaacgatatatggtagcgtggcgttattaagagcaaaggtagaagtgcgcgccacagcgccgggcatattggctacacagtagtgcaccacatcatcaacaatataagtgggctctgcgtgagtggtagggtgagaggtttcgaagcaacccccttggtcgatcgcgacatcaactacggctgaaccgggtttcatgcgtttgatgtgttgctgagtgaccagtttaggcgcagcagcaccagggataagaacggcaccgatcactaagtctgcttctaatacgtatttttcgatggcatctgcggtggaatatacgacgttagctcggccttgaaactcttcatcgagtttacgtagagtatcgatgttgcgatctagaatagtgacatcggcacgtaggccaatagccatacgggctgcgttagcgccgactacaccgccgccgagtactacgacttttgcaggagcaacaccgggaacgccaccgagtaataagccactgccgccacgtgatttttctaaggtttgagcgccagcctgaatggacatacggcctgcgacttcagacatcggtgccagtagtggtaagcgacccatattatctgttacagtctcataggctatgcagacagctttgctcttgattagctcttcagtttgtggaaaatctggagctaggtgcaaataagtaaataaaatttgcccctctttgagcatggctcgctcgatagcttgaggttctttaacctttacaatcatctctgctttcgcaaagacgtctgcagcggtaggaagaatggatgcgcctacagcgatgtaatcatcgtctgaaaagccgatgccggaaccggcatttgtttctacgtaaacttggtgtccgtgtgagacaagctcccgcacgctagctggaatcatgcccacacgatattcgtggttcttgatttctttaggaacgccaatgatcatcctaactccttagattaatttggttgtattgactatatgtagggttgttctatcgaatttgtggctagtatagtgactagtgtgaaaaatttgatgctaaatattaagaagttgtagtatatttttttgcaaggaagtaataaggtggaataaaaaatggtggatagttataagaagccgtctaaggacttagaccgtatagatcgcaatatattgaatgaattgcaaaaagacggtcgaatttcaaacgtagagttatcaaagcgtgtagggctttcacctacaccctgtcttgagcgtgttcgtcgtctagaacgtcaagggtttattactggttatactgcattattgaaccctcagtatttggacgcctcactgttggtgtttgttgaaattacgttaaatcgtggcgcgcccgatgtatttgaacagtttaatgccgcggtacaaaagttggatgatattcaagagtgtcacctagtttctggtgattttgactatctgctgaaaacccgtgtatcggatatgggggcttatcgccgtttgttaggtgataccttgctccgtttgccgggagtcaatgacactcgtacttacgtggtcatggaagaagtgaagcaaaccaaccaattagtgattaaaactcgctaacttaaagcgaatgttggagatctttccacattctgactttcgcgaattgggtttttgcccttgatatggttaaatctccaaacaaaccgagcggcgttggccgctcggactgtttcaccgccatgaaactgcgtatagtgttgcgcattatggccttaatcatagtcaagttggtttatgttcaaagagaacaaaaataaagtcgaaaccattattaaaacgagtgaagaggctccttcttctcgactcaatggctcacaacgtcttaaagaaagcggattgatcttagctttcttgttttcgatatttcttgccgttgctctgtttagttttaaccccgctgatccatcttggtcacaaacggcttgggggacagacattcacaatgcgggtggtttagttggcgcttggttagctgacaccctgttcttcgtttttggctctttagcctatccattgccttttattactgcatttgcagcatgggtgctgttgcgcaaacgtgatgaaggtgacgaaatcgatttcactctttggggaactcgactccttggtctaaccatagtgctattgaccagttgtggtcttgccgacatcaactttgatgacatttggtatttttcatcaggtggagtgattggcgatgtgttgaccagcttagcactgccgaccttgaacattcttggaacaacgcttgtgttgctctttttgtggggggctggcattaccttgttgactgggatctcttggctgcggattgtggaatggattggtgagcgtagcattgcggcatttgtcgggctgtttaaccgcttacgcggtgaaaaagcggagcgtgtgaaaccggcactggtaaagcctgagctgccagttgaagagctagaaccgacattttctgcgtcaatggatactgagattgatgagccagctccgagcttacgtcgcttcaatattcatatgccggaagagcgcgacgtacctgacattcattttgagccccaagtggagcctaaagtcgagttgaaaccagagccgccaaggcagcgcgaacctgctccccatttctcacgggtagccgctcaaaatacacaggtagagcctgtcagctctgcgcgcactcagcaatgggatgccacgatagaagaactggagcaacaggctcgtctagtcgatgactatgctgtcgaggatgatgcagtgccaagcgttcttacctccagcactctttcggatgttgaagattccattttgaccactgccatctcggtggatgaagaagaggagagcctctctgaaaactttaaccactcgttcaatattgaggtagaagatgaagaagttgagcccagcattgctaacttgcattggtcagatgatgaagatgagcttgaagaaacgccttcggttatggtatcgcccgcaatagagtctgattgggaagacgaggatgagcctgacgatcgcgatgtggcggcatttcaaaacatcgtttcgcaagcacaagcgaatgcggctgcgcagcaaaacccgtttttagtgcagaaggccgtaaacttgccgaaaccaacagagcctatgccaacgctagaactgctgtatcatccagaaaagcgtgaaaactttatcgatcgtgaagctttagaagagatcgcgcgtctggttgagtccaaactggctgattacaaaatccaagcgcaagtcgtggatattttcccggggcctgtgatcacccgttttgagctagatttagcgccgggtgtgaaagtgagccgaatttctagtctgtcgatggacttagcccgttcactctcggcgatggctgtgcgtgtcgtggaagttattcccggtaaaccttatgtcgggcttgagctgccaaacatgtcacgtcaaactgtgtacctatccgatgtgattgccagtcctcaatttaaagagtcgaagtcaccgacgaccgtcgtgcttggccaagatatcgccggcgatgccgtggtagcagatctgtctaagatgcctcatgtgttggtggcgggtaccactggttcaggtaagtcggttggggtcaacgtgatgatcctgagcatgttgtataaggcttccccagaagatgtccgcttcatcatgattgacccgaaaatgttagagctttccgtgtatgaaggcattcctcatctgttggcggaagtggtgaccgacatgaaagatgcctctaacgcgctgcgctggtgtgtcggagaaatggagcgtcgttataagctgatgtcggtacttggtgtacgtaatatcaaaggctttaacgataaactgcgtatggctgctgaagccggacatcctatctacgatcctctttggaaagacggagatagcatggagagtgagccgccactattagaaaaactgccttatattgtggtcgtggtcgatgaatttgctgacctgatgatggtagtcggtaaaaaagtcgaagagctgattgcgcgtttggcacaaaaagcccgtgcggcgggtattcacttgattttggctacgcagcgcccatctgtggatgtgattacgggtctgattaaagccaacatcccgacccgtgttgcttttactgtctctacgaaaaccgactctcggacgattttggatcagagtggcgcagagtcgttgctcggtatgggggatatgctctatttacctgccggttccagtcatacgattcgtgtacatggtgcatttgcctcggatgatgatgtgcatgctgtggtcaataactggaaggcaaggggcaagccgaattacatcagtgagattatccaaggcgatcacggcccagaagccttattgcccggagagcagtctgaatcagacgaagaacttgacccactgtttgatcaagtggttgagcacgttgtcgaaacgcgccgaggctcagtttctggggttcaacgccgttttaaaattggttataaccgcgcagcacgtattgtcgagcagcttgaggctcaaggcattgtgagtgcgccagggcataacggtaatcgtgatgtattggctcctgcacctatacgagattaaacagcagaaacaacaaaagtaaaaaaggcgctttaagcgccttttttatcaaccggattgagcgatgcgattggcttagcgtgaggttttagccagttgtgcgacgacaaaaatcgctaatgcgagtaagtttgccgcgaagataacgacaagccactgtggcatagagagcgtcaaaaactgccataccaccttgctacagtcaccatacgcttcaaacagattgggagcccattggttgagcggagcccaagccgggaaggtgacaaacagatcgcaagtagcaaaaggcgaagggttaaactggtagttgacatgctcgatcgccagcatcaaacctttgtagctgctggcaccccaagcagcaaaaccgagccaacgtacgacagggttttgtggtgcaattgcgccaatcaaggcggcgacaccaatccccagcatagcgatacgttcatagatacacatgacacaaggtgcaagtagcatcacatgttgaaagtacatggcacacaaggtaaagaaaacgacaaatgccagcagcaacagccaagataatcgcgactgagaaaaggttttaagggaggataatatacgcacagatagatccttgttaaaaagaaaagctctgaatactcagagctttgtatcttggattagtttcagtttcaattgaaatttagtggccactttgcagtagtgcatctgcagctggcgcgacatgatggctgatccaacctaggctatagaacacttcagtcattggctcaagtaagaacatgatgccaataaaaccaaccagtgaaagcgccagcgtataaggaaacgccatgatgaccatacgaccgtaagagagacggattagtggcgccaaagccgaagtgagcaagaataagaaggccgcttgaccgttcggtgtggctactgaaggtaagttggtgccggtattgatggcgacggccaacaaatcaaattggtcacgtgaaatcatgccttccatcagtgcggtttttacttcagtgatgtaaaccgtccccacaaacacgttgtctgacaccatggaaagtagaccattcgccacatagaagagtgcgagctgagtgccatggtcttcgacatttagtaccgcatcaatcacgggtttgaacagctcttggtcgataataactgcaacaatcgagaagaaaaccgccagcaatgcggtaaacggtagcgcttcttcaaacgctttacctagcgaatgttcttcaatcacaccagtaaaagctgtggcgagaataatcaccgacaaaccaataagaccaacggcggctaagtgaagagctaagcccacaatcaaccaaaccgcgatagcaccttgcacccagagtttggcaacgtcttggtttgtgcggtttttgcgctcttctgagtcaaaatcgagcagaatttgacgaacattggcaggaagacgagctccgtagccaaaaatgcggaatttctcaaccaacatacaggtcagcatacctgcaataaacacgggtacggtaacgggggccatgcggagtaggaactcaccaaattgccagcctgcttggtcagcaatgatcaggttttgtggttcaccgaccatagtggtgacaccacccagtgctgtacccacacctgcgtgcatcagcagtgaacgtaaaaatgcacgatagttttctaagtcatcacgagttaattctgaaataccttcatcatgggtgtgatcgtgagaagagtgaacactttgacccgaagcaaccttgtgataaatcgagtagaaacccaccgccacactgatgatgaccgcaatcactgtcagcgcatctaggaaggcagagagaaacgctgccgtaacactaaaggctatcgaaaggagaactttggagcgaatgccaagcagaattttagtgaaaataaacagcagcagttgcttcataaaatagatgcctgccaccataaacaccaacagtagcaatacctcgatattggcaaccagttcatgcttaacttgccccggacttgtcatcccaatcgcaatcgcttcaatcgcaagtaaaccacccggttgtagagggtagcatttcagtgccatggccagagtaaaaataaactcaaccactaataaccaacccgcgaggaagggattaataaagaagaacactattgggttaataataagaaaagcaatgatggcaactttgtaccaatcaggcgctttaccaaggaaattcttgataaacgcgtttccgagggacatcggcatgatgattactctttaactgttgttatagatagactttgtgtcgtacctgctttcaccaaagcatgagactcagtgtgtagacaaaatcttttcaacagtgatttagcaggaaaataaggttgttcaccgattcaattccagctaagtcactccctgagaaaaacaagcactccgtacttcgaccgcaactctacttgtcgttacacaatagtcaacaacaaatatcatgatgataaaaagttactaaactttcgttaaaaaacgcgatctaagtggtgtaagcataacacaaagttgacgaaaaattcatttagaagccgtgagttaggtgaaattgaatttaatacatctttactccaaagaaatacctctttcgagtaagtttattttgctaattagaaataggatagtgtgagctgtgtccatttaatttcaggtgttttatgtagtcgatgaaaagaaaagtgtttaccagtcatcttataagcaaaatgttcacaatgattcgctcaagttaaattagagtaattgcactatgtctgctttgtgacaagtttatcgatgcttggttttcgacgtacaccaactagtggtatgatgagtgccattcgacccaaataaaacaagtattggattagtcattaatggtcattaaggcaaaaagcccagccggtttcgctgagaagtatattattgaaagtatttggaacggccgctttccgccaggttccatcttacctgcagagcgtgagctttctgaattgatcggtgttacgcgtaccacactacgtgaggtgttacagcgtttagcgcgtgatggttggctcacgattcaacacggtaaacccaccaaggtgaatcagtttatggaaacatcaggtttgcatattcttgataccttgatgactcttgatgcagagaatgccaccagcattgttgaagacttactagctgcaagaaccaatatcagccccattttcatgcgttacgcttttaagctaaataaagagagcgcagagcggatcatgatcaatgtgattgagtcttgtgaagccttggttaacgccccttcttgggatgcgtttatcgcagcttctccctatgcggaaaaaatccagcagcacgtgaaagaagacagcgaaaaagatgagctcaaaaggcaggaaatcttgatcgcgaaaacatttaatttctacgattacatgttattccagcgtctcgctttccattctggtaaccagatttacggtttgatctttaacgggttgaaaaagctgtatgaccgtgtgggaagttactatttttccaatcctcaagcgcgtgaattggccatggaattctaccgtcagttgttagctgtgtgccaaagcggcgagcgtgagcatttgcctcaggttattcgtcagtatggtattgctagcggacacatctggaatcagatgaaaatgacgctgccgtccaattttactgaagacgattgctaatctagcactgttcgttttcgttaaagaagcccgcattgtcacgcgggctttttactattgaaattaatcccaatcccttgagtttagtgatgatggttatcccctttctacttgaagctgcaggggtgttggctacgttcgttcaccccaatcacatagcctctctatgctcatggggatgaattcacttgccgcctacctgcaactccaagttgtttgggtatagagattgacttaatttccccctgcggctttgaaccattgggttaaatgggttttcaaatctttcaattcatctggaccaatcaaagccagccccaaatcttcggcacgcgtaatatcgttatggcgtagagggcggaagctgaccaacatagctcgagcctgtagaccgccgagaaggtcacgcagagattcgagtttgtacaaggtatcgtcaccgtcatcacgcatccctttggttttacactcaataatgtgcagtttgttgttcaccacggtcgccacatccaactcgttacgcacttctctctctccaagctggcgatagacttgcacgttcagcgagcgatcttgaatggttggcatgtcatcttggatctgttttacagtgctgtgaactagggtttctaaccactcaccattggcaaagcgacgagcctcttcgtttatgaacgtgagaatgccgttttcataactggcaatcttggcctcaaccagatcgctgagtagcaagtttaattcgcgatagccttgctgtttgtcagataattccacatccagcttctgctcttttcggcaagtggtggcgaggtaattgagggtggcgaggcctgggcctaattccaatgcattactcgcccagcgttcgccaagctgatacaactgctgatctaattgtggagagagttgatgctcattgaattcgccacgcgcaccaaaaatggtgagatagtcggcaatggtgatgcggtcttgaacttgagtatcgttattgccttcgggatacagccagcataagcagtcactattgggttctacgacaaaaattggccagtggtagctgcgaaacacttcgtaagccgacagcaagcggtggcgtaacccacaactggcgttgaatttgacctcttcaccacgcgctttaagtgtttcggcaagttctcgaatcgcacttttgatggcagaggtgtttgagccggcgggaatttcaaagaagtctgttgagatattacgcttgtttaaaacgtcgctaaggcgttgataaattaccgtttgggtatggtcgccaataaaaataatgtggcggctaacggttcgatgatcgagcagcggtgtcactaagcgaaccgggtcctgatcgataatccctacgtgaatagccataaagtgtcctcatgatttgcttgcatgagtggagggaaaagtggcgcaagcttgttactcatataacgatgaggtgttgaaaaaacaagagcgactctgatgaaaagtcgctctttgtggaaaaattgacagtaagagtatctagcaagagtgctagccgttcatcggattagagtttaaacctatggactaactcactctgttggttggcgagtgcggtcaaattcgcactggtttgcgcaatttgtgacatcgcttggtagctttcatccgagatatggttgatatcttcgatgctgcgagcgatcgaggtggtggtttcgttttgctcaccggccgcttgagagatatgcgtactcatatggctgatttcgatgatcaatgcttgaatttcttccatggcactgttggcatgggaagcttgttcgacggagagttccatatcttgcatacagctctcaataaccttactggctaatgaagagctggattgcagattgctgatcatcgattcgatttctgacgtcgattgcgttgtgcgctgcgcaagaacgcgaacttcatccgccaccaccgcaaagccgcggccttgttctcctgcacgcgccgcttcaatcgcagcattgagcgccaaaaggttggtctgctcagcaatattgcggatgacatctaagatagagccgatttggctgctcatcttgcgtaagtcgccgaccgcctcgactgactcgattaagcgtgtttcaagttgacggattgtgctgatgttggtgctcatgatctggcggcctgactccgatgcggtttcgacttgttgcaccatcgccagtgaattttgcgcactattggcgacttcttgcaccgagtgagccatttccgtcattgcggctgcgacgctagaggtctgttcacgttgactgttgagcttgttttgtgcactcagtgaggtcgtttggtttgtcgatgctgtcgcggtcaaatcatcggaggcactgttgagcttgactaaaatgtcgtgtaggttatcggcaagactattgatgtgacggctcaggcggctgaattcgttgttgtagcgaatctcaattcgttgcgtcatattgccttgggtgaggctttctaaggttttgaggatccgagttacgggttcacgcacactgtgcgcaatgtggtaaccaatcgcagttgccaatagaacgacggcaataccaatcactaccgctttaatcgcaccttgttggtaaactgagccggcttcagcaagggattggttcaggtcgtcggtcgccgtttggttaaacgcgcctaaaatggtcattgctttgtccacttcattggcgaggttggcaatattgttatagagcgcagcgcgagcttgcagatattcattgtgttgatccagtacgccgcctttttggccgatgtcttgggtgaatttcgcgactggctcatcaaagcgctctttcaactgcggcatctgcgtggtgaggcctcggtacgcgtagtttaggtgggtaaccgcttttttgttttgattgaccgctttttccacaaaggcgacatctgaactggctaaggcatcagaagtgatcacttcggcatcttttaatttgatgaagtagcttttggccatcactttgaccgaaatgctgtcgttgtcatcgacaaactctttcatcccgacactcagttctgaatgaagacgttggaactcacgagtcgacttttgcacggaagcttgagcagcaaacatggcttgatagttatccatggcgaggtcagcttcactaaaatagcgggtttcgagctgctttaattccgtgattggctgtgccagttcgggatgattcacactggcttgactcagttccgccaaaacagattgaaagcgctgtttagactgagcaaactcttgacgcataccgtccatgagcgaagtatcttgcgtagtcagaaagtctttaaacgatttatcggcagacaagagttgaacactcgtctgattagagagagagacgagaggcaatgcagcggttgaaacactttcaaaattgctgtgaatttgattcatgccacgaagcatgatggcgacagtcaccacaaacattataatgatcagcgcaaaaccggcatacatacgccgaataacggaaccctgcataatttctctccctcgaaaatcactcattgttattagaattcatcaaagacaaatttgtcttaaaaaagtaacaaaacagtcattattgtattgaggttgggaaacgcgttttatgaccaatacagcaaaaaaaacctttcaccagtgagcttgctcaggttcttttaactgtacggtgttttttattgagctttactatgccttgacgcatactcaagccagaaaaattcttaatcaaaacctttgtatggagtacgtcatggcggaagaaaccattttcagcaaaatcgttcgtagagagattcccgctgatattctttatcaagatgagttggtcactgcatttcgagacattcatccgcgcgcgccaagccatattttgatcatccccaataagctcatcccaacggtcaatgatgttgaagttgaagatgaattagcactcggtcggctgtttactgtcgccaaaaaaatcgctgagcaagaagggatcgccgaaaacggctaccgcttgatcatgaactgcaactcacacgggggtcaggaggtctatcacatccatatgcatttggtgggtggtcgtccgcttgggccgcttttgatgggttaacttcattctccgatgttgatggtgacgaatcacgtggttcaatacattaaacgacctatacgtagcctcactcttacttcactactgctcgcggggtgtgccaatctcactgcgggcaatctttttagccattacagtgcgcaaaacagtgatttatatcagtctgttgcggcagggcaataccaacaagctacgcagttattgcccgattatgtcgccggtgaagtgttagacaaccttgaaaaaggtcgggtttattttcttagccagcaatacgcagaaagccagcaaagtttggctgctgcagatttggcggttaaacagcagcaagaccgagcgatcatctctgtgagtagtaccgcgaccagtgtgggttcgctggcggtcaacgataacttgaatgagtacgaacctgccgattatgaactgggctttttgcacctgtacttagggctgaattatgtgcgcaataatgatctggatggtgcattagttgaaatgcgccgcgctaaccaagttcaggaagccgctaaaaaacgccgtgaacaagcgttgtccagtgcggagcaagagatgcgctcacaaggattatccccgaacttaggcagtgtgcttgcacaatatccagatgccggaaaaaccttacaagcggtgcaaaatggttatctgttgtatctttcggcgctgctttatgaagcggataatgatttgaactcggcttatgttgactaccgcagagcactggcggttgcccccaataatccatcggttattgatggaacacttcgagtcgcgtctcggcttggcatgcaacaagatctcaagcttcttaaacagcaatatggtgagcctaaacgcttaacctctgcgcaaggccgagtcatcgtcatagaagagcagggtatagtacaacctaagcaagcgtggcgactctctttacctttgtctgacagtcgtggcaatacggcgctgtattctttggctctgccttattattcatcttcggtggcgcagagtcgtgtaccgatcagtctaaatggcgctagtttggcctctatgccagttactgatgtggatttgatggctaagcaggcattaacggagcaaatgcctgcgctggtactgcgccaagcgctgcgtgtggtcgccaaagaccaattacgcaaagagacgactcaggaagaggatgtcgccaatttagtgtttaatatttggaatacgttaacggagcagcctgatacacgcagctggttaaccttgcccgccacagtcaatacggccacccaagtggtgaaagcgggtgatcaagtgctggatattgcagggactcactatacctttcatgttccagaaaatggcacagtgttagtttggctatctcaccaaggtaacaatgtgacaatttggcataaacaactagggatacggtaatgagaacgtggctattagcagtattaaccgctttactcttagtgggatgcagtgctaacactgcgggtttgcgagtggatggcgcatcacagcaagtcttatttaacgacagcgctttaagcaaaagcttaagtattgaggacatttcaaccacggaagtggatggacatactcgaggcgtggttcgtttgcagagtaaccaaaaaagcgatgtgcatgtgcagtaccgtttttattggtatgacaatgatgggcttgaagtgaataccaagttaagcccatggaaaaccatcattttgcgaggcatggaaaccgtgtcactgactgaggtttcggtgaacccgaacggtaagcagtttcgcgtccagatccgcgaaagcgatcaataaaaaagcggtcgaataagcgatcgataaaaatacgtttttaagaggaatcacgatgaaaaaaagtgtcattgccctgctaggtttggcggttatcttagggggatgttcgaataaagtgagctacggtgatgcgcaagcggtagaaaccgtcaatgttgactttggttcgaccgacctgcaaaaaattgctgcagaaatggtggatagcatgatgatgtcaggctcggtttctgccatcactcgcgatggtcgcccgattgtgtttgttgaacgtattaagaacaaaaccagtgaacatattgataccgaatcgatcacggacaccataagcaccaagatgcttaattcaggcaagttccgtttcgtcgatatggatcgtgttgaagcggttcgcgatcagttgaacttccagaataatgacgaactcgtcaaccaaagcacagcgatccagtttggtaagatggtcggcgcgcaatacatgctgtacggcaatctatcgagtatcgtgaaaaacgcgggtagtgataaagatgtctactacaagatgaccatgcgtttgatggatctacaaacaggtttaattgagtgggctgacgaaaccgaaatccgtaagcaacagtcaaagagcttactcggtttgtaatccactagcacagggaaggagttggttatggcaaagattgcatggcgagaagcaagcgcactggatccatcgctgttgtcattaaatcactttttctctgtgccgccagaatatgcgcagaccttgaccggaggtctcactaatcgttgctggaaaatcgttgcgggcgatcgtgctttcgtgtggcgtccagcaacgcctattaccaaagctttctctatttctcgatttcaagagtatcaaatcctcaaagcgattgagcatgatcatatcggcccgaaagccgaactggttaatgaacacggcttgcttgtggaatggatcgatggcgaatcactgcgtgatggtatcgcttttgacgtggtattgaaaacgcaaacgcgcattcatgagttggatatccatcgcattccggtagcgccttttaactatcttggtcgagttgaccactactggctacagatccgagatgacctgaaaaccgatgaggttaaagcgctctatgagcagtggcggtctgtgcccaatctcaccgatgtggggcaagtgctttgtcactttgatctggctggctataacatggtgaaaaccgagcaaggacaaagagtcatcgattgggaatacgccgccttggccgatccgcgcattgatttagcgctgagtattgatgtcgctggtgaaaacgtacttgatgcggtattccgttactgccaacggcgcgaattatccgatatcgatgcttgggtctctggtgttcaagcttggcgaccgcgtaccactatgatggcaatgctctggtatctattggcttatcaactttgggctgacgaactttatcgagatcaggcgcagcaacttgcacagactttgcagtcgaaccaaggctagccaaaagcataaccaagcattacgtgatgagcggatgctgccgtcagcggtaaccttgtttggagaaatgcggttcaaattctctttacggtgaaattctctttactgatagtctactaggctgtttaaaaccatactcttcgtggtagattaaaacctcaaggaacgggggagacattatgattatttacttacacggattcgattcaaatagcccgggtaaccatgaaaaagtgctgcaattgcaattcattgatagcgatgtgcgtttcattaattacagcaccttacatcccaaacatgatatgcaacatctactgaaagaggtgcataaggcgatcgagcagtctggcgatccaaatccactgatttgcggtgtcgggctcggtggttattggtctgagcggattggttttttgtgtggaataaagcaggttatctttaaccctaacttgcatcctgaattgacgatgcaggggcgcattgatcgcccagaagagtacgaagacatctccaccaaatgcgttgaaaaattccgagcgaagaatcaaggtcgttgtctggtgatcctatcccgtcaggatgaaattcacgataaccagaaaaccgcgcaagagctacaagactattacgacattgtttgggatgacactcaaacgcataaattcaaaaaaatctctcatcatttgcaagcgatgaaagccttcaaagcggcttagtttccctaagcgatgcgatcttgaacagcctcttttagaggctgtttttacttatccaaacccacaaaaaatctaatgagaatggcttaatctgtggttgcgtgatgaaatcagccctatataatgaccagcactaagatttgttgataaatatcaaaataaattgagagcgagtggaaaacttgccgattatttgtgttagcgcagctttttgctgccgagtaacgtgccactgagagtaaccaaacctcacccaagtctgctggatgttaaacgcatcatggcgataacagattccctcagcacgagcaatcgggctggataataattattcatctttatttgaggattgttgttgtgacacgaattatcgttgtaggtggtggcgctggcggtttagagctggtgaccaaactgggtcgcacactcgggcgcaaaggtcgagccaatgtaaccttggtggatcgcaattcaagtcatctctggaaacctttgttgcatgaagtggcaacaggttcattggatgaaggcgtagatgcgctgagttaccgcgcacatgcgaaaaatcatagcttcgatttccagctcggtagcttagcgtcgattgatcgtgaaagtaaaacgatcacgctcagtgaactgaaagatgagcatggtgagctgctgatgccaaagcgtgatttagaatacgatattctggtattagcgattggctcgacgtctaatgatttcaatactccgggcgtgaaagagcactgtattttcctagatagcccagagcaagcaaaccgtttccgtacggaaatgaacaacgagtttttgaagctgcacgcgaaaaacggtcaaggttctgtggatatcgctatcgttggcgcgggcgcaacaggtgttgagctatcggctgaattacataatgcggtcaaagagttacgcacttatggatttggtgacctcgattcaagcaagctgaacgtgaacttgattgaagcgggtgagcgtattttgccagcactgccaccacgcatttcggcggcagcacaccaagagttgactaagttaggcgtcaatgtacgcacgatgaccatggtgaccaaagcggagaaagatggcctgacgaccaaagatggcgaaaagatttctgcgcacatcatggtttgggctgctgggatcaaagcacctgatttcatgaaagacatcgcaggccttgaaacgaaccggattaaccaattggtcgtgaaaggcacactacaaaccacacgtgatgatgacatctttgtcattggcgacttagcccagtgcacacaggcggatggcaaatttgtaccacctcgcgcacaggcggcgcaccaaatggcttcactggcatttcgtaatattgtggccaaaatgtatggccgcgagctcaaagcttacgtttataaagatcatggctcactggtttccctcagtcgtttctcaacggtcggtagcctaatgggtaacttaactcgtggctctatgatggtcgaagggcgtattgctcgcgtggtgtacatctctttataccgtatgcaccaaatggcgctgcacggcatgattaaaaccggtttgatgatgttggtggggcgtattaaccgcgttctgcgtccaaacctcaagctacactaatcatgttagatagaatcaagcggcactcgtagccgcttgatttttatatgtccccaaacgaaaggggggccgttaggcggtcagtcagtgtatgtctatcaacatagacaggctatggaattaaagagaacacaatgccggctttcggctcgccagcatacaaaaagcggttgggtgctaactgctctcgattggcgccacagcgcagcgctaatgcctgactgggtacattttccggatcacaaacgatctccaaacgtgttaattccaaacgctcaaaacagaataaaatcagcgcagtgagtgcttccttaccatagccttgtctttgataacgatccccaatccaataccccagactggccatattgaaagtatggtaaaactcattaatcgccaccatcccgactaaggtttgcgtttgtcgttcaaatacgccaaatccataagcttcggctttaacccaattaagtcgtgtggcttgaataaactgctctgcttcttgctggctaaacaacgcatgacaccaatccacccattgatgaagcgtttgtgactgacgaatacactgtaccaactcttcagcttcatcggcagtgatgaggcgaagctgcaagcgttgagtgacgatttgaaaatccggagtcatggtttattcctttatctttttatgtatacccaaacgacttggagttaggaggcaagtgggagcatccccatgagcatagaaagttctatgattgggggaatgatcctagccaagaccacagcgcttcaagtaggaaaggtatcatccgatgcactcgactcttgattataagcaacgaagtaagatttgtggaaaatcagtggctttgtggcgtaagagtggaagaagatgtgagcatagcgataaaaaagccgctccggatggagcggctggcagaagtatctttacttcagcggaacgcgaatggtcgctgaacggaagctgttgtgggttaaccagcttggttgtgcattcgttgggatagtaccgttggcgttaatatctgagaaattaaacgcgtactggttccagatacgagtcgcatttcgccaaggcttgcttggattggcggactcatacacaaacacaccgtggttgacttggctttcgcgatcgtagtcattggcaaccatgatcagtgaagcgttattgttgccttctaagtctgccacgactgggtattcccacaaggtgccagaagagttcgcaataatgcccatcacacggcccgtttggccatcgagaatacgcattctcaaacgatcttgaaccaacacttcatcaataccatcaccggtaaagtcgtaagcggagacaccaattttgccgctgttcaggtcatcgttagccacagaccacactttgttgccttgcgcatcgtacatatcaaccgcgtagtaacccgcgtacacaatgcccatgtgtgattggtcagcagtcactttaccaactaggaactgcaccgcattgacttgctgtttgtgtttaaagaggtgtttctctttactccatacattcatacccaagagctgtgagccttgtggaatgtcatagcgtactgtggtcgatttcgacagtgtcacaggaacggcataagggatggttttctctttccatactggcgctaaataagccacttgtttagtgtgccagccaaagaaccagtaagagacggttttggtacgccactcaacacctagataaggaaccgttttagttttccactctaatcctagataagtaaacgcagaatcttttgaccccacagtgacttttgcgccgttatcgagagtaaaactcatctcgaggacaccatacttccaggtgtatttgtttttaccgtaagtcacatcaatggcacggactttactggtatcaattgtgctcagtgagccaccgctgccgccgatcatgttttggctattagcaccaattgcatcgactacagcaccagaacgaatcgctaactgatgattttctgcgagaacacgttgttgatgtgcccagtcggtgtagccataaacggcagactgagcatcaacagtggttgcactggagcttggtttacccagaaaactggagacggcttgtacgctaccacctgggttagataggttgttgactcgccatttcactgagccatcatgctcaagcacagcgatttcactgttctcgggtgtgctcaaagacgctggaaccgacacgaccagttcaggcttatcatcgccatcaaggtttgctacggaagagaaccaaacggtgtcattggcttggtattgccataggtaagcgccgttgttttgatagagtgtaccgttggcaaagacttcacgttggccatcgccattgctatcaaacgcaatcgaacttggtgcccaatcatgactaaagagcaagcctgattcgtaactataaacaccatcggcagccagaatttcaatgttgccatcgccattaatgtctgccagtgcaatatcacctacagaacgccagcctgaagcagatttcagcagttgctttttgatgttgccttggtggtccagaatattgatataaggtgtcaacgcgctggtggagacgatttcaatcagtccgtcaccatcgagatccgcggctgctggtgcatagcgagcatcggcaatcacgcctccattgctataactccacaattcagagccatccacaccgctcagggcgcggatataaccaccattcgcgtacttattaccttcaaaggtgaccacaataatgtcagccacatctttctcatcaattttgccatcgccattatcgtcgttgagttgtacgacaattggcgcggccatcacctgattggactcaggatgaaaaacgctggtagaccaagaccatttcaatttggtctgtatatcactgctgcttgacgcgaatgcggtgctttgagtcattaaatggctcaacgcgagaacgcttatcgcggtcaacgtttttgtctgtttcatggcttgaccttcatctctcttgacagttcgagtgggttgtataatgagtttccttactctctcgttagattgatgcgcaaatacgtggaagagatggtggcatcaataacgatatgctgagagcgataagattatcagtggcaaatactagagggttcaacccactcaaaggcttataaaggcgagttcttgtttgatagacaaatccactcattaaatgtgagagagtggatcatttttgaaacagacgggaggtagcactaacaactttgctctctagaagggggtgagtttgaatccgcttaaagcgcgtattcaaactcacgatcgagtcttactcagcaacgcggcggacttgaatgatcacgcccatgagagggtgatccagatagtgggtttcaccactgcgcatacggcgtttctgatcgagacgataacttttcaggaaggtttcttcctgaactttaggtgagaccgattcaagcatgccggcttgtaccgttgcgccttgttcttcattagtgcccaattctaaaggcgagtcttgcaatacgacttcgcgtaccgagggctttttcaaatccagcacggcttcagcaaacaaaaagtgctgaacgtaaatttgtaaagtgccatcaagttcatacagcgggttggcgatgctcatttcactgacaccatctacgggggcggtgactgtgctgccaactgggcttccattggcttgaaactgcccagaaaaatctcgacctgcttgaatatggaatacaggagcggattggcgaccctgatcattttgacgccaagcggtatgcagtaacacattgaagcctgcgtggttgcgtaatttctgcgcttcactattgagttgataagcggagcttggcaatagtgttacgcctttactttggcgaaagctaacatcggcaaaactgcctgcgcgatcaacattgatggcaggtaagctgttaggccaagactcactcactttttccgcatctactgctcgtttaaaaatgatcacttcaatatcaaactgccgagccgccatgctgggcattgcaatcagcaacagcagcagtgggatcaatcttttcattgtcactccatcgttcagtgtttcacactgggtcattactggtgattttttctatatcccttgcgaatgaatcccgcgaagagattggcttagttcattcgccctaatcttagtgttatctcgcgattaaaggcgtactgatttgccgcttacctgtcctatcaatttgagaatcttaccgagcaggtagtacattttgctggaaattcttcaacatgtcagcgacaaattgaatgcgcgcactgcgttcaaccaaaggcaaggtaaatttcaatttggttggcccatccatcgccagtaactttggttgcgattgcagcagtttaaccaaaaacaccgggttaatgtcagcattgggatagaactctacgtatccgccacgctcatgcgcctcaattttacgcacttttaggcgcatagcattgagtttcagttcagcaatggcgagtaagtttaacgcggcgtctggtaatttaccaaagcgatcaatcaattcgactttgagttcagccaattcgtctttactcgctacgctggcgatctgtttgtacatggataaccgcgtattgatatcggggatgtactcttccggcagcaaggctggtaggcgcatttcgacttcggtctgctcacgcagtaaatcatccagcgcaggttctttgcctgattttagggcttcgaccgcttgttcgagcatttccatatacagagtaaaaccgaccgactgaatctggccactttgctcttcgcctaacaattcaccggccccgcgaatttctaggtcgtgcgtggcgagagtaaagccggcccccaaatcttctaaagaggcaatcgcctctaggcgtttgaccgcatctttggtaatcgctttaggcggtggcgttaacaggtaagcataggcttggtgatgcgaacgaccgacgcggccacgtaactggtgcaactgggctaaacctaagctgtcagcgcgatccatgatgatggtattcgcggtcggaacgtcgataccggtttcgatgatcgtggtacacaccagcaaattgaaacgctggtggtagaaatcgttcatcactttttccagctcacgttcacgcatctgcccgtgagcgacggtaatccgcgcttcaggcaccagtttttctaaatctgcggccactttatcgatggtttcaacctgattatgcagaaagtacacctgaccaccgcgcataatttcacgcagtaccgcttcacggatcacactatcttcactttgacgaacaaaggttttgatggctaaacggcgcgctggaggtgtggcaataatcgacaggtcacgcataccactcatggccatgttgagtgtacgtgggattggcgtggcagtgagagtcagaatatccacatcggcacgcatcgctttgactttttctttttggcgcactccgaaacggtgttcttcgtcaacaatcagcaagccaagatccgcaaaacgaatttcgctagagagcaacttatgggtaccgaccagaatgtcgactttgccgtccgctacgtcttgtaggatttgtttttgctctttggctgatttaaagcgggagagcacttcgacgcggatcggcaagttagcaaagcggtcgcggaagttttcaaaatgctgctgggcgagcagcgtagttggaactaatacggcgacttgcttgccgttatcggtcgcgacaaacgcggcgcgcatcgctacttctgtttttccaaagccgacgtcaccacacaccaaacgatccatggctttggcttgacacatgtcggatagcacggcgttgatcgccattgcttggtcatcggtttcttcaaacgggaaggtggctttgaaggtcgcgtattgttcacggtcgagatgaaatttaaagcccggtttgatttcacgcttggcatacacatccaaaagttctgccgcgacatcgcgcactttttccgccgctttgcggcgcgctttgacccacgcttcaccccctaatttatgcaattgggcggcttcttctgcgccaccggagtagcggctgatcaggttcagtgacgaaaccggcacatacagcttggcttcgttttggtactccagcatcacgtattcgctgaccatgccacccgcttcaagggtttgtaagcctaagtaacgtccgatcccgtgatcaatatggacaacgggttgccccggtttgagctcggcaaggttgcggattaccgcatcactgttggtgacgtttttgcgatcttttttgcggcgacgttgaatcacccgatcgcccagtaaatcgctctcacaaatcaaggcaacttgattatcaccatagataaatccgcgctctgctgagccgagcaccagtgagtatttttccgtttgttggcacgcaaggctgaaatcattttggctttgcgggcgcagtttaatgcgctgtaacaactccagtagcgcttcacggcgaccttccgactcgactgagaaaatgattttgccggtaaattgttcgctaaattggcgcagtgccgccaaaggctctttgttttgatgttcaacggccaatacgggtagtggttgaacttgcgcattcattcgaccggcacgcagctcgataggtgagcttgtcagttggacttgcggcagagttttaaagtgggcaaacagctcatctttacgcagccacaactcattgggcggcagcagtgggcgcagtgggtcgatattgcgttggtcgtagcggtaatcgacatcagttaagaactggtcgatggctttttccagctcgccaaccaccaaaagctggctgttggcgggcaggtaatcaaacagagtctcgctgtgctcaaaaaagagtggctgccaatactcaatccctgccggccaagtgcctttagagacttggctgtaaaccgattccggctcgcggcgcgcttcaaaacgctgtcgccagcggttacgaaactcttcgatcgccgcggccgtcgtcggaaactcatgggcgggcagcaggcgaatttcatccatttcagcgattgagcgctgattgtctggatcaaaggtgcgaatggtgtcgatttcatcatcaaagaaatcgatccggaatgggtcgctactgcccatagggaagagatcaagaatcgacccgcgactggcgtattcaccggggccaaagacctgatcgacatggcgatagctgctgttttctaactgcaagcgcagtttatccagtgaaaagtgatcgccacgtttaacaattaaggtgtgctgcaacaaaaagtcacgtggtgactggcgctgaagcaaggtactgaccgggacaatcgtgataccgcgcgttaagcttgggagctgatacaaacgcgaaatacgatcagaaatgatgtcctgatggggtgaaaaattatcgtagggcagcgtttcccaatcggggaagagcgccacttcgctgtggctaaactgttccacttcgtgtagcaatttgagcgcggtttgtggatcgggcacggcgagcaacgtatggctcgtatgagcattggcgagttccgcaatggccagcgctaaacttgcgccgtgtaaattaccgatggcttttttgtctccggcaccttgcgccgaaaacagagagagtaaagagtgtgtagtcatagtcacgcttgaggtttttctcggtctagtgagcgttgacgcagcaggcgctgctgttggtagagagcggctttgatcagcaaatcttgatccacatcgcgcagcagatcgtacttgagagtcactaaggtgtgctcaggttcttgctggcattgcatcacactggcgtagcaataaatcgcggcggcggggtattccaaaaacagttttacccgcactttttgtccaatctgcagtggtgatttggccaaataggtcagttgactggcaccaaaacgagtggtcgcactgcgtgattgaggatcatcttgttgtgacagcataaaagtcagcagtagattcagtttggcattttgcgcttcaagcagttgcaatacgcttttaaagtcactgtttttcagctccatgcgtgcgctatcactgagttgttccaactggctaaattcgctggcgaccacaaatggcgcggggatctccgcttcaaaaatctcatgagaaggtagggtgaaatgctccgccaacggttccacattgatggttagcgcgtggtgaacagtaaagaattcttggtcattcatagagggttccttctcacatctgtgttgattatcgtcataagcagtaactaatcaaggtatgtccttgttatgggtgtgaaataaacgttctcttacacagatttgataaagaaaaactacaaccgcgcagggattctcgctacattaacgccattctcttcctatggttggatttatgtttcatccgatttcggcttttattggtttgcgctatttgcgcggccgctcaggggatcgttttagccgctttgtctcttatatgtcgacggcggggatcacgatcggtgtgatgtcgctagttactgttttatcggtgatgaacggttttgaggcgcagcttaagtcacgcattcttggggtgttacctcaagcggttgtcaccgaagccgcaggcaaaaccaccctcagcgcaacgcccccagattttgtcacggcattatcgactcagcgcccaccagagccgttagtgcgcagtgacgcggtggtgcaaagtgcctcgcaactggctgcgggtttgttgattggtatcgagccacaacaaaatgatccgattgagcaacacctgattgcaggtcgggtaacggctttgcaagcgggcgagtatcaactctttcttgggcatcttcttgcgcgcagtttgaatgtcaccgtgggtgataaagtgcgtttgatggtgacagaagcgagccaatttaccccgttgggccgtttgcccagtcagcgaaactttacggtagcgggaatttttaataccggttcggatgtggatgggcaactcatggtgactcatctgcgcgatgcggccaagctattgcgctatgatgcacagaccatttcaggttggcggctattttttgatgacccgtttgtggtcagtcagcttgccgaacagccattgccgcaagattggcaatggagcgactggcgtgagcagcgcggtgaactgtttcaagcggtacgtatggaaaagaacatgatggggctgatgctcggacttatcgttggggtggctgcgtttaatattatttctgcgctgatcatggtggtgatggagaagcaggctgaggtggcgattttaaaaacccaaggcatgcagtcacaacatgtgctggcgattttcatggtacaaggcgccagcagcggtgtgattggtgcgctggttggtggtttacttggcgtgctgttggcggccaatttaaatagcctgatggaagccttaggtgttgcccttttttcggtgggtggcagtttgccagtggcgattgatccgctgcagattgtcctcgttattgttcttgcgattgtattaagtctgttggcaacgctgtttccagcctatcgcgcatcttctgttcaacccgctgaggcgttacgttatgaataaccttttacgttgtcatcaggtttgcaaaacctatcaagaaggggagttgcaaactcaggttcttaaaggggtgagttttgagctaaaacgcggtgagttggtctcaatcatcggctcttctggctcaggcaaaagtaccttgctgcatattttgggtgcactggatgacgccagtgaagggcaagtggagtttcttggccagtctttgcatcagttaagttcgaataagcaagcgaagatccgcaatcagcacttgggatttgtttatcagtttcaccatttgctggcggatttttctgctttagaaaatgtggcgatgccactcttgattggtggcatgaatgtggcgaaagccaaagcgaaggcgcagagcctgcttgagcgagtgggtttaggccatcgcgtggcgcatcgtccatcggaattatctggtggcgaaagacaacgcgtcgccattgctcgcgcgttagtcaataagccggatttggtgctggccgatgaaccgacgggcaatctggaccataaaacggcgctgtctatttacgatttgatgcgtgagttgaaccgcgaatccggtaccgcctttttggtggtcactcacgatggcgagttggcggcgaaaatggatcgtcacatgcacatgaaagatgggctgctaaccgatatcacgggggcttaagtgttttcctctctcgctctgtttattggcggacgctttagtcgcgctaaacaacgtaacaagatggtgtcgtttatttcgttgtcgtccacgattgggattgcggttggtgtggcggtgatcatcatcggcctttcggcgatgaatggttttgagcgtgaattgcaaacccgtgttctatccgttatcccacatggggaatttgagggcgtgcgcggacctgtcgaacgctggcctgatttaatggcgcaagccgcgcgtcacccacaaattgttgcggcagcgccgtatgtgaagatcacagcacttgccgaaagtggcactcagcttaaagcgattgaagtgcgcggtgtggatccgcagcgtgagcaagccgtatctcgcttgtcgcagtttattaccgcgcaggcatggcaagactttcgccccggtcagcagcaggtgattttaggccaaggtgttgcggagaaattaggcgtgcaggttggtgatttcattaccttgatgatcccaagtgccaacagtggtgacaaggtgcaagcaccgaagcgggtccgtgtgaaagtcagcggcttattggcactgaacgggcagattgatcacagcttagcgctactgccgctagaagatgcccaagcttatgctcacttaggtagtggtgttaccggtatctctgttaaggtggccgatgtgctgcaagcaacgcagatcgtacgtgatgtgggtaatcaactgaacgaatacgtctatctgcatagttggcagcaaaagtacggctttttgtatcgcgatattcagttggtgcgcaccattatgtatttagtaatggtactggtgattggggtcgcgagctttaacatcgtctcgactctgatgatggcggtaaaagatcgcgcaggcgaaatcgctatattgcgcactatgggcgcgaccgatggcttgatcaaacgtattttcgtctggcaaggcgtgttttctggggttctgggtagtgtggtcggcagtgtattgggtatggttgtcgcctttaatttaacgcctttgatcaaagggttagagcatctgatcggacatcagtttttatccggtgatatctatttcgttgattttcttccttcacaggtggagtgggcagatgtagtgctggtttcagggacggcgattgtgctgagtttgctggcgacttggtaccccgcgcggcgcgcaagccgactcaatcctgcgcaagtgttgagtagtaaataacatcaaacaaaaaaggaccttcgggtccttttttcatgctgagtaaacagagtttgcattgtttaagctgcgcttgttcgcaactctcttgcaatcgtgagtgcacaagatgcgttaaggcagattctccggcattttactggtgcgacgtttttgccaactgcgcacaacggagtagcgccacaaaccgcgaatcccaaagtaaccaattaacgatgccaataccgcgcaaactgcgcagccgagtaagaacggtggcccaatggtgctcatctgattgagtaaaaattcccaagtcagctcaaaatggaaggattgagcgggagttcccatcaaccatgcgccgagtttgtatgtgaaataaaagatgacaggcatagtgattgggttggtgatccacactaaggcgatggagagtggcagattgacccccagtacgatggcgagaccggcagccataatcatttggctgggcagtggtacaaaggccataaacagccctaccgcaaacgcgccagcggcagagcggcggtttaagcaccataggtttgggttatacagcacattaccaaacacgcgcagcgctttttggcgtttgatcacatcgtggtcaggcataaaccgtttaatgaattttcttggcatacgggattatgactctcttgtcgaattactggtctctcatttctttttcgatcaccgtgctgtctgccccttattggccttggatgccgagttggggttgggcttggttatgccttattgttatggttttgctcggttatcaccgagttggccgtcaattccttggcttcgtggctgccatactaaccattgtgctacagggcaaccttatacgagatcaatccaatgtgctctatcaagcagggccggatattatcataaaaggccgtgttgacagcttttttacgcaaactcgttacgcttatgagggttttgtcctcattcatgaagtgaatggacaaaccttaaacaaaatgactcgccctcgcatacgtttaagtgcccctttactgttacaacccaatgatcgcgtcgaattttcggtaactctcaagccgatagtgggtcgactcaaccaaaccggctttgatttagaagcgcattacatggcgcaatctgtcgtcgcacgagcggtcgtaaaacctgacactgcttatcaaattgtgcaagagagtggcataaggtcaagtttgttttttgagctagagcaattaacgcataccagcccataccaaggattgatcttagccctgacgtttggcgagcgaaaaggtattgatgagcaagagtggcaagccttacgcaatagtggcttaattcatttagtggccatttcggggctgcacattggtatcgcttttagcgtggggtattttctcgggctcggcatgatgcgttttcatgctcagttattgtggtccccttttgtgtgtggggctttactggcggtgctctacgcttggctggccggatttacgttgcctactcagcgtgcattgattatgtgcttactcaatgtggcgttgatcatgttggcttttcctctttccgcgctcaagcggattctactcaccttagtcgcggtcttgctttggtcgccattcgcctcactttcaaacagtttctggatgtcgtttttggcggtcgcgattgttctctaccaattagccagtcaaagccagcgtcaggtgtggtggaaagctcttctttgggcgcaggtgttcctcgtctgtttaatggcaccggtcacggcctattttttcggtggcttaagcgtaacggcagttctgtacaatttggtgtttattccttggttttcgttggtgattgtcccagctttgtttttgggtctattactcatggtggtatggcctagtgtggccgccgcttactggccttgggtggattggacgtttttaccgctcgattgggctttgcagtttgccgatgtaggctggtgggtggtccccagcaaagtacaaggtgtggtcgcagcgagtgtggccatcctcttgctttatcgatttatgagcctaaaagcctgcagcttattattgggtatgattggcttatggtggtggtttccctctctcactccactttggcgaatggatgtgctggatgttggacatggcttggcgattgtgattgagcaagatgagcgagcaattgtctacgatacaggcagcagttggccgggaggcagctatgtgcaaagcgtgattgagcctatgctccaacagcgggggctacgccaagtggatggagtgattttaagtcatcttgataatgatcatgcgggtgattggcaaggtttagctgagcgctggcaacccaattggattcgtgccagccaactcgggacagagtttatgccttgtatccgtggtgaaagctggcagtggcaatctctccattttacggtgttatggccaccacaagcggttagccgagcgtacaaccagcattcgtgtgtgattcgtatgaccgatactcagtctaaccattctgtactgctctccggggatgtcacagccatgggggagtggctgcttgctcgcgacggagcgcaactgcaaagtgaggtgatgatcgtgccgcaccacggcagtaaaacatcgtccaccgcagagtttattgcccaagtgaatcccaaacttgcgattgcttctgtggcgaaagataaccgctggaatttgcctaatccgcaagtcgtggcacgttatcaagctcagcaagttgagtggctagatactggacacgctgggcaaattagcctctttttctatctagatcagctggattggtttacccagcgtagccttggctggcagccttggtataggcagatgctgcgtaaaggagtagaatgagcgcaattttataatcagaaaagcttctttatgtcattgcactctgacgaatctaactggcagacctttaagcgtctgtggacttatatccgcttatacaaagcgggcttggtggtttcaactatagccttagttattaatgccgctgctgatacttatatgatttctttactaaaacctttattggatgaaggttttggtaatgcggaatccaacttcctgcgcattctgccgtttatgattttagggcttatgtttgtgcgtggtttaagtggatttgcctcttcttactgtttgagctgggtgtccggcaatgtggtgatgcagatgcgtcgccgtctgtttaaccattttatgcacatgccagttcgttttttcgaccaagagtcaacgggcggcttattatcgcgcatcacatacgactcagaacaagtggctggcgcaaccagccgcgcgttagtcagtattgtgcgtgaaggggcgagcattattggcttgctcaccttgatgttttggaatagctggcagctctctttggtactgattgtcgtcgcaccagtggtggcctttgcgattagctttgtttctaagcgttttcgtaagatttcgcgcaacatgcaaacggctatggggcatgtgacttcatcggcagagcagatgctcaagggccataaagtggtactgagctacggcggtcaagaggtcgaacgcaaacgctttgacaaagtcagtaacagcatgcgccagcaaaccatgaagctggtatcggcacagtcgattgcagacccagtgattcaaatgattgcctcacttgctctgtttgcggtgctctttttagccagtgtcgattcgattcgcgctgagttgactccaggtacatttactgtggtgttttcagccatgtttggcctaatgcgtcctctgaaagctctgaccagtgtaacgtcggagtttcagcgtggtatggccgcttgccagaccttgtttggtttgatggatctcgaaaccgagcgcgataatggcaaatatgaggcagagcgtgtcaacggtgaagtggatgtgaaagacgtaactttcacctaccaaggcaaagaaaaacctgcgttatcccatgtttcgttctcgattccgcaagggaaaacggtcgctctggttggccgttctggctcaggtaaatcgaccatcgcgaatctgtttactcgtttctatgatgtcgacagtggatcgatctgtcttgatgggcacgatgtgcgtgattacaagctgaccaatctgcgtcgtcactttgccttggtttcgcaaaacgtacatctgtttaacgacaccatcgccaataacatcgcttacgctgccgaaggtgaatacacccgcgagcagattgagcaagccgcacgtcaagcccatgcgatggagtttattgaaaacatgccgcaaggtttggataccgtgatcggtgagaatggcaccagtttatctggcggtcagcgtcagcgagtggcgattgctcgcgcattgctgcgcgatgcacctgtgctgatcctcgatgaagcgacgtcggcactggatactgaatcggagcgtgccattcaagcggcgttagatgagctgcagaaaaacaaaaccgtgctggtgattgcgcaccgtttatctaccatcgaacaagcagatgaaattcttgtggttgatgaaggtgaaatcattgagcgtggtcgccatgctgatctgttggcgcaagatggcgcatacgctcagctgcatcgcatccagtttggtgaatagtggtgatagaaaagatctggtttcaccgccatccattgggttatttgttatggccactgttgtggccattcagcgtactatttggtgtcatcagccgctcacggcgtaaagcatatcaaacgggcgacaaaccctcctatcgtgcacccttacccgtgttcgtggtgggtaacattacagccggtggtaatggcaaaacccctgttgtggtttggctggtggaaacgctgcaaaaccttggctatcgtccgggggtcgtttcacgtggttatggcgctaaagcgcccagctatccgctcgtggtgaatgagcaaacgccagctcagcattgcggtgatgagccgaaactcatttttcagcgtaccaaagcgcctgtagcggtcgatcctgtacgcagccaagcggtaaaagcgctgcttgagcacggggtcaatgtcatcgttacggatgatggcttgcagcactatgcgctgcagcgcgatattgaaattgcagtagtggacggcgttcgccgtttcggtaaccaggaattgatccctttaggtcctctgcgtgaacctgtcagccgactcgatgaagtcgatttcattatcactaatggtggcgtggcaaaggccaatgaaatcgcaatgcgtctgcaaccgacggatgcggtgaatcttaagacgggtgaacgctgtgcagtgagtaagctcactcgcttgtgcgccatggctgggattggccatccttcccgattttttaatactttgcgtgaactcaatgccgatttagttcattgccaaggttttgccgatcatcaagcctttgatgctgctcagttaaatcaactggcgcagcaaggcgctcatctgatcatgacagaaaaagatgccgtaaaatgcgctgagtttgcccagccaaattggtggtatctgcccgtttcggctcagtttgctccagaagcggagcagcgtattgtggacaaaattaaagaggtaatggaaccgtatggatcaccgtctgcttgaaatcgtcgcttgcccagtatgtaaaggtaagctgacttacgataaagatcgccaagagctgatttgtaagctggatcgtctggcttatcccattaaagaaggcattccggtgcttttagagccggaagctcgcagcatgagcatggatgagggacgctaatgtcatttactgtcgtgatccctgcgcgttaccaatccacgcgcttaccgggtaagcctctcgccgatattggcggtaagccaatgattcagtgggtatatgagcaagccatgcaagcgggagccgaccgcgtgatcattgcaaccgacgatgagcgtgttgaacaagcggttcaagctttcggtggtgtggtgtgtatgacttcgccgaatcatcaatctggtacagaacgtctggcggaagtggtggcgaaaatggcgattcccgccgatcacattgtggtgaatgtgcagggtgatgagcctttgattccaccggcgattatccgccaagtcgcggataacttagcggcatgcagcgcgccgatggcaacgttggcggtggaaattgaagatgaagcggaagtgttcaacccgaatgcggtgaaagtgatcaccgataaaagcggttatgcgctgtacttcagtcgtgccacgattccttgggatcgtgataacttcgctaaagcggataaagctatcgttcaacctttgctgcgccatatcggcatctatgcctaccgcgcaggctttatcaatacctatctggattggcagccaagccagcttgaaaagattgaatgtttagagcaacttcgtgtgttgtggcatggtgagaaaatccatgttgcggttgcgttagaagctccaccagcaggggtggacacgccggaagatttggaagtggtgcgacgcatcgtggctgagcgtgcgcagtagttatctttcagctaagcagaaaaaagctcctttgcaggagcttttttattaagtgttagggatgttgtattgcagccccagtacttagattcgactttccgagtcgttctttttggggcaggttgcgaggatctctcttcttcctgtgtctttgacctcctccagtttgacttcaaaaccccatagacggtgcaagtgttttagcacctcctcgtagcttggatctaacggaatacgatcgtgtggtacatactgcaaggttaacgaacggtcgcctcgaacatcaacgctatacacttgaatgttgggttcaagattactgagattgtattgcgccgcgagtttctcgcggatttgttgatatccgagatcatcgtgaatagcactgatttcaatgtgattttttctatcatcatcgcaaatcgcaaagaacttaaagtcgcggatcagcttaggtgacagatattggctgataaagctctcatctttaaagttgcgcatcgcaaaatgaagcgcatccaaccagtttgcgccggccaactctgggaaccactctttatcttcctcggtcggctcttcgcagatccgcttaatatcacggaacatggcaaaaccgagtgcataagggttaatgccactgaaataacggctgttgtagggcggctgtgccacaacgctggtgtgactgtgcaaaaactccagcatgaacttgtcgctgagtaagccttcatcataaagatggttgagtatggtgtagtgccaaaacgtcgcccatccttcgttcatgacttgcgtctgcttttgtggataaaaatactggctgactttacgcacaatacgcacgatttcacgttgccaaggctccagcaaaggggcgtgtttctcaataaaatagagaatgttttcttgtggttcactcgggaagcggcgctgcttttcttgctctacggcttttttcggtacggtacgccataaggcattcacttgtgattgcagataagcttcgcgctcttcttgacgcgctttttcttcggcaatcgagattttttcggggcgtttataacggtcaaccccgtaattcattagcgcatggcaagagtcgagtagcttttccacttcgttcacgccaaatttctgctcacactcagcaatgtagtttttggcaaacagcaggtaatcgatgatcgagctggcatctgtccaggtttggaatagatagttgcctttgaagaaggagttgtggccgtaacaggcatgcgccatcaccagcgcttgcatggttacggtgttttcttccattagataggcgatacaaggatcggagttaatcacaatttcgtatgccaaccccatctgaccatgtttgtaggtttgctcggtttgaatgaattttttaccaaacgaccaatggttgtagttgattggcatgccgatgctggaataggcatccatcatctgctctgaggtgatgatctcaatctggtttgggtaagtgtccaaacgataaagctctgccacgcgacggatttcttgatggtagcgctcgatcagttcaaacgtccaatctgggccatcgggcagtcgcttactgttcgctactttacgcttaggtgcggctttggctttggtagtcatctcacaatctccctacgcattttccttttggaacagctccctaaacacagggaaaatatcttcaacactgcggatgttcttcatcgcgaagttatcgaaggaggcctgtaatttttcatattcgtgccacaacgtttggtgtgagcgacgcgtgatttcgatataggcatagtattggcaatagggcagcagcttgttagagagtaactctttgcagcgtggtgaatcgtctgcccagttatccccatcagaggcttgtgcaccatagatgttccactcacccagtgggtagcgagcttcaatgatttcatgcatcagcttgagtgcactggacactatggtgccgccggtttcttgcgagtagaagaagtcgtgctcattcacttctttagcttgggtatggtggcgaataaataccacttccacgttttcataagtgcgagttaagaacaggtacagcagtacataaaagcgttttgcaatatccttggtcgcttgatccatcgagcctgacacgtccatcagacagaacattaccgcctgactggagggaatcgggcgcttttcgtagtttttgaagcgcaaatcaaaggtgtcgataaagggcacgctatcgattttattgcgtagctcctcaatctcttgcttgatgcgcatctcttccatgatttgtggtggttcgctgcgctgaatacgttcgagttcctcttccaactcactcatcaaacggcgtttaccagcggtcatcgccgtacggcgcgctaaagattgttgcagtgaacgcaccactgaaatattggagggaacccccgaggtttgaaaacctgcgcgatgggttttccattcggtgattttgttaacttggtttttcttgagattcggcagcgccaaatcttcaaacagaatatcgaggtattcatctttggaaatttggaatacgaaatcatcgctgccttcaccatcggcactggcctcaccttcacctgagccgccgctgccttggccacctttagggcgatcgattttatcgccacgaataaattggtcattgcccggatgcacacgttcacgcacgccgcctttgccttgatgaaacatcggctctttaatgtcacgagttggaatagaaacatcttctccagactcggtattagtgattgagcggcggttaacggcatccgcaaccgactctttaatctgctctttgtaacggcgtaaaaagcgttgtcggttgacggtacttttatttttgccgtttagccttctgtcgataaattgcgccatgagcctctccctaatgacatcacctcagactcgaacgcgagtttgttgagggggtgacctacagcccaacagcgattctgtggggtaggtaacaccgtaggtggcggtagttacactaccgccgaccattacacggcatacacactatgaggatttacgtactcgcaagtaccactcagacagcaagcggacttgtttttcggtgtaccctttttccatcatacgagcgacgaagtcatcgtgtttcttctgatcgtcggatgaggtcttagcgttaaaggagatgactggaagcagatcttcagtattggagaacatctttttctcaatcacagtgcgcaatttctcgtagctggtccacactgggttttgcccattgttgttggcacgggcacgcagtacgaagttaacgatttcattacggaaatcttttggattgctgatccccgcggttttctcaattttctccagttcactgttgagtgcagagcggtcaaacagttggcccgtttctggatcgcgatactcttgatcttgaatccagaagtcggcgtaggtgacgtagcggtcaaaaatattctgaccgtactcagagtaagactctaagtaagcggtttggatctctttgccaatgaattcgacatagcgcgggattaaatagcctttgaggaactcattgtagcgatccgccgtttcttgtgggaactgctcacgctcgacttgctgttcgataacgtagaacagatgtactgggttcgcggcgacttcggagtgatcgaagttgaacacgcgagagagaattttgaacgcaaaacgggtggaaagcccagacatgccttcgtcaacgcctgcgtaatcacggtactcttgatagcttttggcttttggatcggtatctttgagcgtttcaccatcatagacgcgcatttttgagaacagggaagagttctctggcactttcaggcgtgacaatacgctaaattgcgccagcagatcgagtgtgcttggggcacaaggggccttggagagctcactgtgatccaacagtttttggtagattttgacttcttctgaaacgcgcagacagtaaggcactttgacaatataaacccggtctaggaacgcttcgttgtttttgttgttacggaaagtttgccactcggattcgttggagtgagcgaggatcatcccatcaaatggtaacgcagaaagcccttcagtaccgttatagttaccctcttgggtggccgttaacagtgggtgtagcactttaatcggtgctttgaacatttccacgaattccatcaaaccttggttggcgcggcatagcgcaccggagtagctgtaggcatctgggtcatcttgtgaaaagtgttcgagtttacgaatatcgactttaccgaccagagacgaaatatcttggttgttttcatcacccggctcggttttagcgaccgcgatttgatccaagatggatgggcgtactttcactactttgaacttagtgatgtcaccgccaaattcatgcaggcgcttggctgcccaaggtgacatgatggaacgcaagtaacgacgatcaatgccatattcttgtttgagcagttcaccatcctcattcacatcaaatagacagaaggggtggtcgttaacaggactgcgttgaccattggctgataacacataaattggcatttgttgcattaaggctttgagcttttctgccagtgatgatttaccgccgcccacagggccaagtaaatagagaatctgtttgcgctcttccaagccttgcgcagcatgcttgaggtaagcgacgatctgttctatggcttcttccatgccataaaaatcttcgaaagttttataacgagcaatcactcggttggaaaaaatacggctaaggcgcgagtgtttggatgtatcaatcatctcgggttcgccgatagccagcaacaagcgctccgcggcattggcataagcacttttgttttctttacacagagccagaaagtcctgaatggacagctcttcatccttggcggcttcatagcgtgcctgaaagtgttcaaaaatactcatagttgtttcccctttgaaaatgtcatgacgacatacaaccgctgtatacaaatccctaacaatttaagcctagtctgtaatctactcttttgcttaaaaattatggttttatttcaaaatcgtgatttcgagtaagccgataagtcaaagcggcgaagaggaatcggtgtgatgggaaaatcgcaaaataaaagctggcctagagccagcttaagagaataaagagatggaaaagtggaattaggcgttcatgatttgacgcaattcattacctgacagatggtattggcgtgggcagttgcgccaagtggtcagcatgcggcggtatttggccaacatcggcatttggctgttgaaatggtgttcgcctttatcaaactgaggatagagaccttcagagtccactaagaaacggacgtaattgaccaactgtgcttcggtcgccatatcaaagcctaggaatgtcaaacggcgttgatctacatctttgcgtgcggcatcgtccagcattctgttggattcttgcatcgcatgatacatctccatgatgtcgatgatttcacgacactcggtttcaggcaggcagccaaactcgcggttcagttcacgcatgtgtagctcatagccacgctcaacaatcgtttgtaagcgcttgtatttgtttgcgttattagggtcgagttgtgacataaggaaatattggttcgataggatcaaacgctgagcgttggtcatttccatgtaaagcctcacttcaaatcagagttattattttgctgatttaaggttaacagcattggtgcagagtgaaacatgatctcaacacggttttaatagtgaaagcacaaaaaaacaccatgcttaatgatgatagtggttgtacaaataatcgcgatcggaaaaaacgcgcagccactcagggcggaatacggccaaaatggcgagtgccatgccattcagcaggccttcggggaaggcgagtagcggaacaaaaatcaaatagttgtcggtgattgtgatccagtcataagcgcctaactgccagatataaagggagttaagcaacagatgcaaactgccggtaacgccggcattaaaaaagccagccacaaaaataaacacgaagatgtttctcggtaggtagtgatagctcaaggcaaaaatcgagtaactgatcaagattggcagcaaactcgacagcagtagatattctggtaaagcggcaaaacttattttgccaaacagtgcgagggtggcgctgaccggcagggtaagaataaaagcgctgcgccaaccatacatcatggtcagtgtggttaaggcgagaaaatgaatgctcaatccttctttgacactggcttgtgccgaccaaagcagaaagagacccagcatcacaaagtaggtgagatgttggaaggatttgtcatctcgaaacttcggccacagcgcgtgttgggtatcttttctgacccaaaacaacacgatgaagagaatgatggtcgaagcgatttgtgcgagttccaattgcgttacctaaaaaaataccaacctgaggttggtattttttacgataacgtcgagaggatgaatcaatattttacgtttgagtgatactgctcaaggatcgctacgattttatccatggtttctttgcttggcggattcacgccttccagtggatattcttcgcccatggcttcccatttgtgtgcgccaagtttgtggtaaggcagcagctcaattttctcgatgttttccatgtctttaataaactcacccagttgatgagcagatgcttcatcatcggtgtaacctggaaccaccacgtaacgcaaccaagttttttgaccaatttgatgcaggtagcgcgcaaaatctaaggtgcgtttgttagacacgccaatcaaatcttggtggatctcatcatccatctgtttgatatcgagcatcaccaaatcagtcacttccaacacttcgtcaatcacaggtgtgaatttacgcacgtagccattggtgtctaaacaggtatgaataccttcggctttcgctgcgcggaaaaagtcacgcacaaattcgggttgcagcatggcttccccaccagagcaggtgatgccgccaccagaagcgttcataaaatggcgataagatttcgcttctttgatgatttcctcaaccgtgacttcacgacccgtatgggtatcccaagtgtctcggttatgacaatacttgcagcgaaacaggcacccttgcaggaagacaataaagcggattcctgggccatcaacagtgccacaagattcgaaagagtgaattcgaccaatggtagacatgagcgcttctcagttatgtagtttggccgttattttattacaaatagcagggattaaataggtttatctccctgataattggtcgcatcaccagtgacagcaagggctggtgggcatttggactcttttctcccttcttctcatcctgctcagttgtgctcttatgtatccgactctcttggagacgaacaatcaatttcagtgaaaaatgggtaagttcggcatcctaggtctaaacttttgctatccataagaaagagtatctgttgtcagtgggcaagctggcgaactgaacagtgcagtgatgcagtatttaaaaaggaagtgaaaagatggatgtaacgcaactttcacaaaagcaaaaaatcaccttatttatccttgtactttgcttgggcttcatcgggttagcggtttttaccgcgcaaagtttatctaagatgaactcgcagtatcaacaaagtggcgatgtgaccgcgggctctgcggctttatttgcgactcaagcacagctgtttgagttagccgctgagcgtgaacatctctcgtcaaacaaggtgtctgagattaaaacgcgcttggctcagctaatgcagaaagtggaaggggataagcgctttcttgccgagaataactttgctaatgaaggtaacgctttacagcaagcggtgcaggcttttaacgacgatatgcagccgtggcttgagattaaaggcgagcttggttttaacgtcgatgatggcaagttggccgagctgaaaaaactggcggtgactatagaaaagaaaattgatgaaaccggtatggtaaccatcaattccgattttcaagccatgatcaaagcccagcaaaattacttactacaaccgaatgaacaaaatttgcgcttatttaatcgggcgttagcgggttttgtcagcatgtcgcaatcctatgccatgctcgatctgtataaagcggaaattgagcagtttaaaaccacttttttgcgagtcagtgagctgtcgcagcaagtcaaagatatcgaaaaaaacttactcagtagtgaagcaacagcgcaaggtgtgattgaatcaaccgcgcagcgtctagaagaggtgagtagtcgttatcaatcgttagctgagaaagcgggcgagcaaaccttgctctctattttagtcgcttgcgtgattctggcagtgttgaccgtattgctgtttatgatggtgagtttctcgctatctaaagcgttaacacagataggccgcgtattagaaaagctctcttctggcgatctctctcagcgcttagctctgatatccaataaaaaagatgagtttaatcagttagcgtttgcggtgaacaagagttgtgaaaacctcggcggcctagtgcatgtcgtgcaagatcgtagtgtggcattgtcaggggatgctgtggcgctcaatcaagcgattgataatctggtacgcggtcagtctgatgtgatggatcaaacccaaaggctcgcgtcagcaaccgaagaggtcagtttaaccacgcagcaagtctctcattctctcgaagtggtcgccaatgtgagtaaagcctcgactttagcggctgcggaaggcagtaaagttattagtgctgcgattggctctttgcgtgaggtcgggagtattttgcagtcagccgccagccatattcagcagctagaacaagcttccgccaaagtcgactcagtgatggacatcattaacggtatcgcagagcaaacgaatttattggcactcaatgcggcgattgaagctgctcgtgcgggtgagcaaggacgcggatttgcggttgtcgccgatgaggtgcgtagtttagccgtcagaacggtgaatgcggtgagcgaaatttccggcacgatagaaactatgaaaaaagagagtgcggaagtgattttgtttatgaaccaatccgagcagaccatggaagaggggcaaagcaaaggcaatcaagccatgcaagcgttacagcgaattacccaagggacggatgaagccgcatcgcaaacggaaagaattttttcgtcgataaaagagctgtccgcaaccagccaagcaatggccgaaagcatgagccaaatttcgagtgcgatgcaagcgttggagtcgtataacactcaactgcgtgtgaccagccgtgaagttgagacacgcgcagagagtttagagcatgattgccgacgctttacgttgtagagcctcgattgtccaccctagaagaaggcgtacagcgccacgttaccggtaccgctaatcgactctttatcttctttaaattcaggagtgttagcggtgaaggttaaactggccccaaaactacgagcatacatagcaaaaccgaccacagcagtggcttgccatggctcaatatgcacttggtaatactcggcgggttgatctaagccattcagcggtctgtcaccttcaatcgtcacatcgttaaatcgatagcgaccctcgatgccggtgaacacaaaccagccttggttggatgccccaatcatgccgggggtaaacggattctcaaccgaaatttgggctgcgccaaagttgttttctaaatcggttccccagcgcaacatgagtccagaggaaaggtcactgcgaaagttgccgatattcacttcagaaatattggccagctctaactctgtaccggctaaagcatggtaacgaccccagttaaaatgggagcgataacctaggctacccaccaattgatcttccacttggtatgcccagccattgggctcatcggatttcgtaatgctgtgcaccaatttttgcgcttcttctgacaaagcgctttcccctgtcatccctaaggtgagattgaagcgttgtgcttgttgtggatgtaggcttaagtaattgaactcagtgtgtagataacctgcataagggcgttcgttcggctgtggtttggtcaattcaatatcagaaggcgtccacatcttatgcccgagggtgaattcccatttgtccagactgggagcgccccaaatggataaactgagcggttttgcaagccaataaggggtaatggcgccagaggtatagcttaggaaaaggccattagtgtagttttgatctaccccgaatacaccgtcgttatcgatgctcagggagaaggttgaagtctgcgccgcagccgcgtaagtgctgatgaacagtaaaggtaaatagcgaatcgatttcatggttagcgaactatgtctcggagaaataaaacaaaagctcattaatcatgagccattgtggcgaataaacctagtagagaagaacacaaatgtgtcgtgagatacagaaataaatcctgttgcgcggaaaaacaaaaagccccgtcgaaacggggctttgaagaggcttactgaatcttatagagattcagtgaaagtacgagcaataacgtcttgttgttgttcagcagtcagagagttaaagcgcactgcatatccagatacacggatagtcagttgtgggtacttctctggatgcttaactgcatcaagcagagtgtcacggttcagaacgttaacgttcaggtgttgaccaccctcgatgcctgcttcgtggtggaagtaaccgtccatcaagccagctaggttcgcacgctgtgagttctcatctttacccagtgcatttggcacgatagagaaggtataagagataccgtctttcgcgtgagcaaatggcagtttaccgacggaagtcagagacgctaccgcccctttctcgtcacggccgtgcattgggtttgcacccggtgcaaatggcgcacctgcacggcgaccgtctggcgtgttacctgtcttcttgccgtataccacgtttgacgtgatagtcaggatagactgagttggtactgcgttacggtaagttttcagtgaacggatcttgttcatgaaacgctcaaccagttcacaggcgatgtcatcaacgcgtgaatcgttgttaccgaattttggatagtcgccttcaatttcaaaatcgatagctacaccatcttcgtcacgaattggttttactttcgcgtacttgatagcagacagtgagtcagccgctacagacagacctgcgataccacacgccatagtacgacgtacatcacggtcatgcagcgccattagagccgcttcgtagctgtacttgtcatgcatgtagtggatggcattcagtgcagtgacgtattgtgttgccagccaacccatgaagtgatccagcttgccccatacatcgtcgaagtcgagcacttcgtcggtgatcttaggcatttttggacccacttggattttcagtttctcatccacaccaccgttgattacatacagcagcgttttagcaaggttagcgcgagcaccgaagaactgcatgtgtttaccaataaccattggtgatacacaacatgcgatagcgtagtcatcattgttgaagtcaggacgcatcaagtcatcgttttcgtactggatagacgaggtatcgatagacactttcgcacagaacttcttgaagccttcaggcagttgctctgaccacaggacagtgatgtttggctctggagatggacccatggtgtacagtgagttcaggaagcggaagttagtacgtgttaccagcgtacgaccgtctagacccataccacccatagattcggttgcccaaattgggtcaccagaaaacagctcatcgtactcaggagtacgtaggaaacgaaccatacgcagcttcatgacgaagtggtcgatcatttcctgagcttctacttcagtgatcttgccggctttcatgtcgcgctcaatgtacacgtccaagaaagtagaggtacggccaagagacattgcagcaccgttttgagatttcactgccgctaggtagccgaagtaagtccattggattgcttcttgtgccgtttcagcagggcgagaaatatcgtaaccgtatttcgcagccatctgtttcatttggccaagcgcacggtgttgttctgcaatttcttcacgcagttgcatggtcatttgcagatcttcgccgttttcaaatttttcctgcagagacttgaactgagccagtttgtctttcatcaggaagtcgataccgtacaacgctacacgacggtagtcaccgatgatacgaccacggccgtaagcatctggaagaccagtcagaacgccagatttacgacaagccagaatttctggagtgtagatgtcgaatacaccggcgttgtgcgttttgcggtattcagagtagatttttgaaacttgtggatccagttcacgaccgtatgctttgcatgaaccttccaccatacggataccaccattagggatgattgcacgtttcagtggagcatcggtttgtagaccaacgatcttttcaagatctttgttgatgtagccagcgtcgtgagctgtgatggtagagataagagaagtgtcgaagtcaacaggagcgtgagttgagttttcctgtctgataccttccattactttagcccaaagcttgttggtcgcttcagtaccttctgagactaggaaagattcgtcgccttcgtacggtgtgtagttcttttgaataaaatcacgaacgttaacttcgttttgccagtcacctgccgcaaaaccttcccaagctttagcaaattgctctgccatgacatacctacctttatgagtagaaaaaacacgtactgttttcgccgttgagccagctatccccgaagggagcagtacactcttcaataacgatatccaaattcacactgtgactatttgaatatggatatcgctattagttcctttaatggagccactctacgctaaaaatttttcgtaaaccttaaactaaatcaataaaagttaaaaaattaaaataaagtttgggtagcgcggtcagcgctacccaaatcaagaatggtgattacaaccaagcttgcagaccgtattggctttccaacatgccaacagcaagcatagcaatcaaacagatgattagcacaccgcccgggatcacaactttatcgatgaaggacaattttgctgcgcgctctttgtcaccaatcagaccgttgttgtccagtagcatagtcaaagcccaagccagtacagggtttactaccgctgaaccgaaaatacagatacctgctgcttgtgaatctttggtgtttttgatcatttgcatacccgcttccagcagaggtaggaatacaccgactaacagagcacagcgcataactggtggccatacggctgcatccattgggaaaccaagaattgcaatcgtcatcaccaaacagccaaggataatggcaccacctggaattgggcgtttcgcaatcgccgctgggatcatgtaggtaccccaagaagaggtgatgttaccgccacccagcgctgtacccaccatttgacggatagaacacatagtcatggtgtcatccacatccatcagtactttttcagtacgttttggatagttcagctcttggaagatacggtggcctaggaaatcgggtgaccacatggcaaccgccaaaatcgcaaatggcaatgaagcgatgaagtgttgtagtgttggcatacccaacatccaaccttgctcagtgctgccccaccagtaaactgggttcaggtttggcaatcccatttgggtttcaaatttcaggtcaaaacccgcacccaaggcaagcgcaatcacaaggccagtaaaggcacacaccggaatcgccacccagcgcaagttaaacttagcgagcagagcataaatcacgatgttcacgccgagcacgacaagaccaatgtagcccatgctgcctgccgcaacgtcggcagattgcaagccaacggcccattcttgtatcgaggtgatttggctcatcgtcccggtaaaaccgaggaagatcagcaaaccgcctgccgtaccctcagaggtgaggttgaccagtttggatccacctttgaaatagctgagcaaaagaccgaaaacgccaaggaggatagcaagtgcgagagggtgtgcgccggccagagcgatagagccaatcagaggaatcattggaccgtggttgccagcgaggttggcacgagggtttaagaaacctgaagcaatcacacagaagaacagcgcagggaaaagcatttctacgcgagcaacttcgatagcaaattctttgcccaagttaatatggtcccacgcttgagtcaggccgtcagcccaagacatcattactgcggagtacatagagataatgccgatggtacccgctagtgcaggaactaagtcttccagctcaaagcggaaatctcgcccaggtaaattgagaccaaagcggcgtggcttcatgatttgcagttcatgatccagatattctgagcgagttgcaaactcagacgcaggacggtgaagctcccggtagcttttcgtctcaatgtctgagcgctctttgttcataacgtctgacatatgattcctcatatttgtaaaagtaagtaattcagtggtgaatactgtttaattgcatgaataaagaaagtgttgaagcgtttctgacacgagtcaaatgggctacttctaacacaaatactgatcattatgatgaccttatatttgtggcgagtttaacgtgcttatcaataagggcgattgatcttgatcactttaagaataaatatgaaagaaaactacacatgcctagtgatatcagacacatagggggtatttgctttgaaatattttttcatcttgcgagttttattacgctttaaaacgttgaaaaaggctcagaaaaatgcacgctttgctaacagtagaagtcagaatgtgtaccgaatgtgactttgttaaaaatttattaataaaattatttggcaaaaatgactatttattaacctttttggattcatgttatttagcactgcagataaacggtaaatcagcgagtccgcgtgagtatcgataaattaagcgatgggagtgcaaggtcagagtcaatactggcattgttttcagtaaaaagagaacaagacgaattcacttatatttgcatttgtgtgcaaattaaatcgctattcagtcatatttgatgggttaataatttgttgcgcggctctgggttgagtgttagcttgtttcaaaaatgaacagtgaagttcatcgatatagacagggagcgttagcgcatgacggatgtacccgcgcttgaaattaagaatttacacaaaacttttggtcagaatgaagtgctgaaaggcatctctcttcaagcacaaaaaggcgatgttatttccatcattggatcgtcaggttctggcaaaagtacttttcttcgttgtatcaatttattagaaactcccactgcgggtgaaatctgggtcaagggcgaactgatccagatgaaaaccacgcgtcaaggcacagtgcagcccgccaaagagaaacaagtgcagcgcatccgttcgcgtttagccatggtgtttcagagttttaatctttggtcacacatgaccgtgcttgaaaatgtcattgaggctccggtacacgttctcggcgtgcccaaagcgcaagctattgagcaagcggagcgtctactgcgcaaagttggtttatacgaacgtaaagactattaccctggacacctttcgggtggtcaacaacagcgtgcggcgatcgctcgggctcttgccgtagagcctgaagtcatgttgtttgatgagccgacttcagcactcgatcctgaactcgtcggtgaagtactgggcgtaatgcgagatctggcagaagaaggtcgcactatgttggttgtgacacatgagatggcgtttgctcgtgatgtctcaaatcatgtgatgttcttgcatcaaggcaaagtagaggagcagggtaagcctgaaaaactgtttaaaaaccctgattctgagcggttgaagcagtttatttcgtctatttattagatgggcaaatagaggcatctatggtttcgaaagatgaggtcgtcggttgctatggacacggtggttaccgataagaatagtgcgcagtcgaacctgagtctcaaagagtgaatttcaagtaacacattgatattaaaaaaatagtaaacacaacattaagacaaacaatcacaggagtatggatatgaaaaagtggttagttgcgacagcattaattgccacaacaatcagtggggtaacgcaagccaaagaatggaaaacggtgcgttttggtattgagggcgcttatcctccgtttagctggacagaagccgatggctctttgaaagggtttgacgtggatatggccaatgcgttgtgtgcggagatgcaagtggagtgcaaaatcgtgccacaggattgggatggcattattccttcactgttagcgcgtaagtacgatgccattattgcagcgatgtcgatcactgaagagcgtaaaaagaaagtggatttcactggtaagtacgctcagatcccgaacaagtttattgctaagaaaggcgcggatttagccttcactaaagaaggtttgaagggcgtgaaaattggtgtgcagcgtgcgaccactcacgataaatacatcactgacaattatggtgacacggtcgatatcgtgcgttatggctcgtttgatgaagcgtatttagaccttgccaatggccggatcgccgcagtattaggggatgcctccgcattagaagagggcatgctcaacaaacccggtggtgatgcttatgaatttgttggcccttcactgacagaccccaaatggtttggcgaaggtatgggcatagcggtgcgcaagcaagataaagagctaaccgaaaaactcgatgcggcgattacggcactgcgtgaaaaagggatttatcaacaaatacaagctaaatacttcaagtatgacgtttacggtgaataaaagcgcttcttatcacttcgagttgccgtccacaggacggtagcttgaaatcatggattcgcgattaaagctcactgtatttcgggttgttggcactcgttcctgatgtcaccaacaacccgtaatccaactcagggaacgagtcatatgctggatttacaaggctatgaagcctctattctgaaaggcgcgctgctgactattgaagttgccgtgctgtcacttttgctagcgatgctgctaggcatgttaggcgcactcgctaaaatggcaccctaccgctgggctcgagccattgcgacactctataccaccatcattcgcggtattccggatttagtactcatgatgctgattttctttggtgggcagattttactcaacaatggtctcagttggtttaatgagttcatcaaccaatggctgacagcccgagatccgaatcatgaatgggtagcctatctgcccgattatgtagatatcagcccttttgtcgcgggcgtgttaaccatcggcttcatttttggggcttatatggcggaaacgtttcgtggcgcgatccttgccgtggataaaggtgaactcgaggcggcgaaagcttacggcatgagtgctgccatgagctttcggcgaattttattaccgcagatgattcgccatgctattcctggttttggcaataactggctggtgctgctgaaaacgaccgctcttgtctcaatcatcggccttgaagatatggtacgcatcagttcactggcggctggctcgaccaagatgccgtttaccttttatatggcggtggccatcatctttctattttttaccagtgtgtcgaccggtttgctcaagctgctagaacgtaaattcagtattcatacgaggtaaagatggacttttctctgattatcgacagtttgcctatttacctaagtggactttggaccactgtctggctagtgagcctttcactcgtaatcggcttgctgtgcgccattccgctggcgattgcccgaaatagcaagcaaaaatggtttagccttccggcatggggatacatctattttctgcgtggaacgccactcttagtgcagctttatctgatttattacggtatggatcagtggtttccggtcaaagatactttatgggagcatgcttggttctgtgctttggtggcctttatcttaaatacctcggcctatacggcggaaattatccgtggggcgatcaacgggcttccgaaaggcgaggtggaagccgccaaagcttatggtatgagccgttttcaaacttaccaaagaattattttacctagtgcgctgcgtcgttccttacctgcttacagtaatgaagtgatttttatgctgcatggcagtgccgtggcagggatcgtcaccatcatggatttgactggcgcggcacgattagtcaattctcgatactatgcgccatttgaagcttttttgagtgcagggctgttttatatggcgctgactttcatcattttgtggtgttttaaacaggcggaacaacgttttcttgcctacctaaaacctcgcagctaaataaaaaatccccatcaatgtcgatggggatttttaagtaagccgtcagagcactcgattacttgaatgttgtccagataggcgcatgatcggaaggtttatcgatcgcacgtaactcataatcgatgccagcctcttgacaagtttcagccagtgttggtgttgccaaaatcacatcgatccgaagtccacggttgtcttcaaagccgcgtgagcggtaatcaaaccacgaaaattggtcactgacgtcaggatgcaattggcggaaagtatcgaccaatccccaatctaaaagcgtttgtaaccactcacgctcttctggttgaaatgaacatttacctgtttgtaaccagcgtttgcggttggcttcgccgataccaatatccagatcgagtgggctgatattgatgtcacccatcacgaccagacgctctgaattactgcggtgttcacgcagataggtcatcaaatcacgataaaactgacgtttgtaaggaaacttggtttcgtgttcgacgttatcaccttgtgggaaatagccattgagaatggtggtcttctgcccattctgatcagcgaatgtcgccatgatcatgcgcttttggtgttcttcattgtcggttggaaagcctttgatcacttcgacaggcgtttgtttgcataaaatggccacaccgtagtgcgctttttgaccgtgaaaatagacttgatagcccatggcctcgacttcttgacgaggaaacgcctcatcatggactttgatctcttgtaggccaatcacatcaggttgatgcttgtcgatcaacgcttgcagttgatgcaatctggctctgagtccatttatgttgaagctgataactttcattgcgattccttttggttgacttgggactgatgttatcacctaagctcgggatctcaagtccggcgaattattggttcaatagtgaaccaacaaagtaagcaaaaggtaacaaagttgttgtttaaaagaatcaatagacttatttttagccttatcactcgatatacatgtctaaaacgcaaacataaggatgttgtatgcgccaaatttctgttcagtggaaaatcacactacttgcggggctttgtctggtttttacttctctcgctttaatcggtttttcaatctacaacgcgcgtgcgagccagcaaaccgccaagctgcaaagttcggagtctgtcattgataaatcacagcaactgctgcaaaccggtgctttattgaacgcgacagagatttcagagtacctcagtgaagcgatatatcgtgcggaaatgttggccgcgaatgctctgtttttgaaaaataattcagaagaaaacttcggtgaaagtgaggtgttacgcacgtcgcttgatgaaatggtgcgtaaatccgtacttggctttgacaccatagaaggcgcttatctggtatttcgtcccaatatgctcgacagtgaagattccaattatgttaatgcagattatgttggctcaaacgatattggtcagtttgccgcctactggaccaaggcggcaaatgggcaaaacgtgatttcccgcgtattaactcaagcgcaactcacagaagaatcgaataaggagcgttttgtctgcccgattgagcaagcatcgccctgtattacatcgccgcgcatggtggagtttgaaacgggacgctatctggccacgtcgctgtctgtgccgattttgattgatggtgtcgccatcggcttttatggcattgatctgacgctcgcgcctttgattggtatcactcaaaaatccgataacaacctgtttgatggacaaggtaaagtgtcgattgtcagtgaaaacaatgcgttagtggcgagtgatgctgcttttttaacccttggcgaaacttttcaaagcgagaacctcagccgctcaacggtgagttcattgttgcaggctgggcaagtcaacactcaatggagtgaagatggacaatggttagtggtttttgctcctatcaaagtggcgaatcaaaactggggtatcatttttgaaatgccacgtcaaagtgtcatgcaagatgccgaacaactggacattttacttacagaacaacttgagcgcggcattcgtagtgaattgatggtgggtacgcttatggtcgtcgtggggctattggtggtcactcttatggcgatgcgtttggtgagaccaattcgagcggttgctgaacgattacaagatatttcctctggtgaaggggatttaactcagcgtttgcaggtgaattctgccgatgaaattggccaactggcacagggctttaacctttttatggataagttacagccgatcatccgccgagttgtggataatacgggacaagtcgtgagtaccaccgagcaggtcaaaagtacggttgaatcaacgcgccgtagcagcgaagcgcaatttaaagaagtcgacagtgtggcaaccgccgcagaggagatgactcaaacctcagcacatgttgtcgagaatgctcagcgtgcggtgaatgcggcgagcgatgctcagcgagctgcccaaacaggggatgaagtgatccgccattcacagatgcagatgaaccagttggtggacagaatgaatcttgccgttcctgtcgtggaagagttagcacgcaacaacactgggattattgaaatcttaagtgtgattgaaggcatttcagagcaaaccaacttgcttgcattaaatgcggcgattgaagcggctcgagctggagagcaaggccgcggttttgctgttgttgccgatgaagtgcgcagccttgctagtcgtactcaagcttctgttggtgaaattcggtccgttatcaacaaagttgaattgggtacgcaagatgtcgtgaaagcgattcaaggcagcaatgaaaccgcacaagctacggcagagcaagtcgcggatgcagttactcagctcaaccgagtgttttcggcgattcatgccatcaacgagatgagtcatcaaatcgtgcaagctgcgcaagatcagcagacggtatcggctcaagtgactcaaagcgtggtcaatattcgcgatttaagtgcgcaaattctttcagaaacggaagcatccgaaaaagtgggagagcaaattgcgcggttgtcgtttgaacaacaaactctcgtcgggcagtttaaagtgaactgaggccaagcgttgtcagacgagagttactcgtctgacaggggggcgatggtttttggttgaatgctgggtgatactgcagcgtctgccagtttttgttcaaaatcgcgtttgacgatctcaagcgcagcaagcgcgatctggggttcaatcgcatgagactctaataaaaagataagatcgaccgcgagtttgatctcatcagaggcttcattcagtggaatcgatggagtcgacatttacgcttttctctcttgagtggtaattcgtttctcaatttttatttttgcttcacggcagcggttgagtcgctgctcggattgcaacagagcttgctgagccgccgctttttctgttgccgaggcttgctcaagcaacagggctttatcacgcaccaaatccatcaaacgccgttcccaatcttgatgttgagccagctcctgataaagctcattaatgggttttttaaaataagcgtgcggtttcggttcgttacgacgcacattttgagttgaaagctcacgagtcagtgcagcgatttgtgcaagtagccgttcagataaatattccgcgcgcaatgccgtcaaacgtccactctctttttcacggattaaggcttgcagtgttgaatgagcttcttcaacacaaggtgttaatagctttccgtggcaatggaataacacctcatcaaataatgggcgatgatgttcaccacgttgacggtcgaactgggcggcagaatgcttgagctcgttgagaatcgtatgaaatttgctgtagctctccatcatcccacccaccatgcgtcataagccaatttccccgccaaaatcgtgaccactaaaataaataggggacggataaacggagctccaaagcgaatggctgagtgagctccgacgtacgctcccgccatcaaacagactcccatcgtcaaacccaacagccaatcaatatgaccgagtagggcaaaagtcaccagtgaggtgaaattactggttaaattcatagctttggcaagtcccgaagccagcaggatattgaagcgatacaacgccattgagctgaccgtccagaacgcgccagtgccaggacccgctaagccatcataaaatcctagccctatgccttgcaggatctgcttgcgatgcaatttagggcatggttcaggcgtgacactttgttccgtttgatgggggcgatgtaaaaccgtatataaagccgcagccagaataatcagcgggagtactttacgtagccaatccgtgctgatcgcatcaacggccaaagtgcccagtatggcgccaatcaaggttgcaataaaagcgcgtttccaacatgcaggatcaaagagtttttgacgatagtaagtccatgccgcggttgatgaagcaaacgtcgcagctaatttattggttcccaaagccaaatgaggcggtaaacctagcgaaagtagcgctggtacggtcaacattccgccgccgcctgcgaccgcatcgataaatccggcaataaaagcaacaagagccagcaccattatcgtggtgggttctatccattccatcaaaagcgcaatcctaattgtggtgagttaatcgttattatcagtattcaatcgtgcgcttaaagggcggtaaggcatccaacaacgcttttccgtaacgctttgatactacccgccgatcaaggatgaccactctaccagaatctcgctctttgcgcagtagacgcccaacagactggatgagctttttgctggcttcaggaacggtaatttgcatgaaagggttaccgcccagctcttgaatatattcggcatgtgcttgttctaccggagaggttggaacggcaaaggggattttggtgatgatcagattttcgaggagttcaccgggcaaatctagaccttccgaaaaacttccagtgccaaataaaacactggttttctgtttttcaatcagctttttatgtttatttagaatttctgatcgagatttctcaccttgcacctgcagtgcccaaccacgttttgtgaactcgacttttaaagactctgccacttcacgcatttgccaataagaagcaaagaggaccaaattggctttgtcagcttgcagataacacaatacttttttggctaaataggcagtatagccctcggcttgtggctccatttccatttttgggatcagcaattcaccttgcgtagggtaatcaaatggcgaggctaaagctaaaaattgcactccatcttccgctttgtcactgatcccagcttgccgacagaagaagccgaatgaatttaatgctcttaaggttgcagaaactaatatcgcgcccacacagcggctccaaagctgctgatccagttgccagccgatttcgagtggcgaaacactgactaaatagtcaccttctcgttcaggactgacttcaagccagcgtgctaaaggggcccctttatctttgttaggttttgccatcagttgccatacttgggtcaagttttctagacgttgtacgtaaaaccccaattcgcccaacgcaggttcagcgatgcgtgttgcaagttcgccttcttttactttttcagcaattaaatcagctactttactcacagattgcatcgctttttgtgatgacttactaagtgcttgtgactcatcagccagccattgtggtaactcgccgtgctcaaaacggtaaattccctcaacaaattgttcagccataaactgtttgggtaactgattcaaagtcgggattaagtactgtatcgccgtgcgcgcctcttcagcgaatcgctcggcacgtttttcatcacctagagcggtgaacttggataaggattgattgagcttttctagccagcttgcggctccttttaacgtcgcggctgccgatgcatgctcgcgcgcgaccgtagggagatggtgcgcttcgtcaaaaacataaatcgtttcttcgggtgcggggaggataacgcccccacctaagtccgcgtcggccatcactagactatggttagcaataatcacatcggccttatccagttctgaacgtgccttctgaaacggacagtggcgatgaacactaaagctgccattacaactatgtttatcgctgacaatgactgaccacaattcatcactaatcggacttggccagccatcacggtcaccatcccatttcccttggcttagggcagtatgcagctctgcaagcagctctgtctcatgaggtttgggtttactttcaaatagcgcgatttgcccatcatcaatcccacaggctgcggctaaacgttcgctacaacaataacgttgacggcctttcgcaagaataaatgagaagttttgatcactgatcctgcgataaagcggtaagtctttattgagcagttgctcttgaagagccactgtggctgtggagatcacgactttccgcttattcaccaccgccacagggataaccgccattaaataggagagagactttcctatgcctgttcctgcttcggccactaacatttgagtcgatttgtgataagccccacaaagggttttggccatctcggcaactaggaaattttgagcgcgacgaggaatgaaattttccaattgattttgtagattttgataactgttgcgaatggaatcttgaatgttttttgtcagcatagaggtgtccaaagtgcgatggcgcgatggtagcacagatcactgagtgatacctacttcacgaaatcgtatgcttttaatagaaatctagatcttgttcacaaataaaaactgaaccttcagagacttaaatttattttgttttataaaaaatatatagctccaaatcctaggtttgatttttattaatatcctaatttcgccatttaratgttaatttttggagttttattctggttttctstcgggttgtaatcctgtgatttcgtctgtttttgttaagaactaagccgaaaaaaatcatgaaataaatgtaatttattgaattttaaggttttatgtttttttctgtttttttttatggtatttgacatgcagaatattcttttgcaatcttaaccacgaatctaatggcggtggtgaccaaacaaagagttggaaaaccaccttcaaaaaacagggaaccggacaaggaattcccatattaagaaaaggcagtggattaacatgaaaaaaactctattagcactcgcagtgcttgcagccgcaggctctgtaaacgcagctgaaattctaaaatcagatgctggcacagttgatttttacggtcagctacgtacagaattgaaattcttagaagataaagatccaacaattggttctggttcttcgcgcgctggtgttgatgcaaactacaccgttaacgatagcttagcgttacaaggtaaagtggaattcgcactaaaagacagtggcgatatgtatgttcgtaaccacattcttggtgtaaaaactaattttggtaagtttagctttggtaaacaatggactacatctgacgatgtatacggtgctgactactcttatttctttggtggtacaggtcttcgttacggcacactgtctgatgcactacacgattctcaagtcaagtatgtttacgaagctgacagcttctgggttaaagctggttacggttttccagaagataatgcaaagcaagagctagcagaactgtatgtaggtgcaacatttggtgatttggctgtgcacgctggtggtggtcaaaaccgtgataaagcattcaaagttggtagtaatacggttggcacaacaaccacagatattaaagctgacgtaacaaatagttactttgaagtgacaggtgagtacactattggtgatgcactgattggtgttacttactacaacgcagaactagatgtagaaaataacccactagtgatcgatgaagacgctatttctgttgctggtacatacaaagttgctgacaagacaaaattgtatgctggctatgagtatgtaatgcaagaagcgaacactggcgcagatgaagatggtactcttgtttacctaggtgttgaatacaaatttgcaagctgggctcgtgtatatgctgagtatggctacggcgatggtacaactctgggttacaccaacaagggttctgacgcagaagttaaagcaacgaaagtcgacagcgctaataactttggtatcggtgctcgtatctactggtaagatctcgaacacgtttattgagaaagcccggctgctgccgggcttttttattgtgatgtgcaagataagtgattattgttgttgtgtttatttttatacgaaacaaggtagttagataatgaaacttaacccactgattttaggtcttctgttgtcattttcagcaggtcactcattagccgatgtagtattaaaagtgccagaaaatattgatttactttctgtaaatatgcaaaaaccaaaatctgaaggcggattatttggtgataaaacgattatgcttaaagatggcacgaaccagattgtgtttcgttatattcctactttcgatgatggtgacgatgttaagaaggtatatagcgatacaattattgcaaaatttgagagtgaaaatgccactcttcactttaagattcctagttatcgcaatataaaagaagcaaatgagaaaattcaaacaatggagtggcaacttgttgacgaaaaagggcaatctgtcgctctagtagaagacaaactactcaatccaggtgttcaatggggcagaaattacagccaagaagctacagaatataaccaaaatggaggggttgctgcgatcggatacctgaaagtagttactaatgaggctcagctatctgaaaatacgacacaagttattatgagcgaagcttctcaaccattagaagtagtcggatcatcaaataacctgactcaacttcaactttggtatagcaaagcctcaaaagaagaacgcaaagcgtttaagaaatggatggtcgatcaagaataagcgaaagcctgcgcatgcaggctttactctattatccacagcactttttatatttcttgccactaccgcaagcacaagggtcgttacggccttgtttgatggcggctggaaattcaccgtcaatataaaaccaacagttattttcttttagaaatcgagagcgctcttcaaggcaaaacactttaccctcttgatcaagaaacgctttaaagtgaacaaaaccttcgttaggggttgcgcccatttgggtcgaaatgatctcaaggcgaagccaatggctatgtaccgattcgctaatcgcatcacgctcattactggcttggcaagagggatggtatgtttcaatcacaaactcaacattctttaaaatatgggcactaaaacgtgctcgcatcagctgttcaggaacttgagcactgtgaggattgagatgaataggttcgcaacactgcgagtaaggttgagtatttccgcaataacaggacatagaaaagataaacgttgagtaggtagatggagtttatcggcccgtaagcgtaattaccagtttaggtttgtacaccaagaagatcggctgtccatttgacggcttcgatatagcattctgttggtgcctcgtttggaaggttaagtgcttgcccaagagtcacaacttgcccccaatccgccatttcataagctttattcaatgccaatatttgccctaaagtgccactgccttgagttaaggcctgtttgacttcttcctcgatgggcatttctttcacaatggaatcaagggattgatcaagtaggctgtctagcacagaaaacataccggttagaaatccggttccgggggcaatgtttgtcggcactcgttcactgagcatttcgcaaaagcgggcgcgtagaatggcaagattataaagatagtctggtttggaatcttgtgttgaagcaatcgcaacgagcgaaatgaatttacggagtttctgttgccctagatagaccagcgcttgacggaaagattggatttttgaactcactgttgctgaagagtttacgaacgtgagtagcttatatgaaagagaaatgtctttggcgacaatcgtttcaatttcacgaaaatcaacttcgggtttcgcgacttctttaagtagttgcacaatggtcagaaaagagggttgcagggctttgcgctgaataatttcaggcttactaaaaaagtaaccttgaaaatagtggaaacccgcttgcttggcctgttcaaactcttcgtaggtttcaactttttcggccagaaactcaattttcatggagcgcagtttattgataaagagcttggctttcgggataggcacgagacgaatatcaaatttgataatcgagatataaggtagaaatgctttccaatcattgcttgggataaaatcatccagtgcaattttgtatccgagctgagccatttttttgatagcactgagcagttcaggggttggtgggcaatcttcaagaatttcgacaaccagacttttaaccggaaacagcgtgggcaccatattgagtaaactttgataagggaagtttacgaatccaagaagatcacccagagtgctgtagtgtgcggtcaagaaatgatcggaaaggaggcggctagtggcttcctcgggatcgatgtctggaaacgtgtttttaggcccatcacgaaagagaagttcgtaaccgatggtgcttttttcacgatccaatatgggttgtctagcgacatacgagtacttcaaagatttacctattttcgggttgttgtttcttttgtcagtattttaagggtttaccgagataagtattggtcaagaacatggttattactaattgattactcaatatttatgagtggtctcgacaataatgagtagccagttagtttagaatagaccaagatcgagctttggctataccaatctcctaacacaatccgtgttttgagagtctggtcatcggtttgaatggagtgaattgcagggcggtgtgtatgaccgtgaatcattaaatctacgttatatcgatgcataaccgcgatgacttcgctgggtgtaacatccatgatcatcatggacttatgttgtttgtcatctcgtatgtctgactgtattttgcggacaagcttttgcttaagtgcaaaaggaagaagtccaaataatcgctgtaaccaaggctgatgtactttggctcgaaattcaaggtagcgtgtatcttgggtgcagagtgtatctccatgcagtacgacggctttttgcccatataagtcgatcacggcttcatccggtaacaactgcactcctgtttgttgagcaaaccgtttcccaaccagaaaatcgcgatttcctttagtgaaatagcatggcacaccttgttgagtcagttggcgaaactcggatttaatctgctcggcaaaggtggttgggtcatcatccccaatccaaaaatcaaaaaggtcgccaaggacataaagtgcatcagctttgatggcttcttcgcgcataaattgaatgaaggaagcggtgatatcaggatgcttgggggagagatgaagatcggaaataaatagtgtatgcatgtttcacagcaaaaggagcgcctaagcgctccgagtaaaattaagcttcgatagtggtgccagtgatcaccacttcctctagagggacatcttggtgcatgccataagaaccggtgctcacgcccttgatcttattaacgatgtccatgccttcaaccacttcaccaaacacgcagtaaccccaaccatcacgactttcagaacgaaaatcgaggaaagtgttgttattcacgttaatgaagaattgtgagctcgctgagtgaggatccatggtacgcgccatggcaatcgtacccactttattgctcagaccattatttgcttcgttacgaataggatcgcgagtctctttttcacgcagtcccgaagtcataccgccgccttgaatcataaagccgtcaatcacacggtgaaagagagtgttgtcgtagaaaccttcacggcaatattgctcaaagtttgcgctggttactggcgctttttcaaagttgagctgaattttgatgtcaccaaaattggtatgcagggtgatcatgagttttaccttcgcatttatccattgagagccagagtttagcctaactttttgtgcattcaaaacatcaaatggatgacctagtaatctttgagttgttatactgtccgccatttataattttgatggtaatcagatagagatcatgttgaagatttataactcactcacaagacagaaagaggaatttaaaccaatcgttgccggcaaagtgggcatgtatgtgtgtggagtcactatttatgatctctgtcatatcggacatgggcgtacatttgtttcatttgacgtagtagctcgttatcttcgttaccttggctacgatcttacctttgtgcgtaatatcaccgacatcgatgacaagatcatcaagcgtgctgcagaaaacgcagaaacgtgcgaatcattgacagaacgcttgattcaagaaatgtatgcggatttcgatgccctgaatatcaaacgtcccgatgttgaaccacgtgcgacggcttatatcgaagagatcattgctctggttgagcgcctgattgagcgtggttttgcttatgttgctgataacggtgatgtgatgtttgaagtgagccaatacagcgagtacggtaaactttccaagcaagatcttgatcaactccaagcgggagcacgtgtggatatcgaagcggcaaaacgcagtccgctggatttcgtgctctggaaaatgtcgaaaccgggtgaaccaacatgggaatccccttggggctctggccgtccgggctggcacatcgagtgttcagcgatgaactcatcaattttgggtacccatttcgatatccacggtggtggttctgacttgcaattcccacatcatgaaaacgaaattgcgcaatcttgctgcgcccatgatacccagtacgtcaacacttggatgcacagtggtatggtgatggtagataaggagaagatgtcgaaatcactcggtaacttcttcactatccgcgatgttttgggccattatgatgcagaaacagtgcgttatttcttgatgtcaggccactacagaagccaattaaactacagtgaagagaatctcaatcaagcacgtgcttcactagagcgactctataacgcactgcgtggtttagatcgtagcgtgccagccgcggggggcgaagagtacgtgacgcgctttactgctgctatgaacgatgatttcaatacgccagaagcgtattcggtgctgtttgatatggctcgtgaaatcaaccgactcaagagtgaagatatgaccaatgcgagcgctttgggcagcttaatgcgtgagttggcagatgtgatcggtattctttaccaagagcctgaggctttcttccaaggtagtgcggaagatgaagatgcggcgcaaattgaagctttaatcaagctacgtaatgattctcgtgcgacgaaagattgggctaatgctgacttggcgcgtgataagttaaacgaaatgggaattgtgcttgaagatggacctaatggtacaacttggcgtcgtaagtaacgagcaacaaatgaaagggtgggcgtaagcccactctctttttctggcacgtgtagcccatctttaaacgaacaaggcaagtgagttatgtctgtcatcttagggattgatcctggatcgcgcgtgacggggtatggtgtgattcgtcaacaaggacgacaccttatctacctcggtagcggttgtatccgtacttccgatctcgagttaccgttacgcctgaaacaaatctatgcgggcgtgagtgaaatcatcacccaatttcagccggatgcctttgccattgagcaggtgtttatggcaaagaatgccgattcagcattaaaacttggtcaagcccgcggcagtgcgattgtggcggcggtgaacgcagaacttcctgtttatgaatatgctgccagactgattaaacaagcggtcgttggtacgggagcggctgataaaagccaagttcaacatatggtgcagcagatgctcaaactgcccggtaagccccaagccgatgcagcagatgctttaggtgttgctatttgtcatgctaataccaacaaaactctaattgcattggcagggcaggcaacgagtgcgcgtagaggtcgttatcgttaaatgtagcttgatgctacgagcattttactggctatccatccagttattgattatcatccagagcatctttcctccctctattataaggaaacacaagtgattggacgtcttcgcggtacgctgattgaaaagttacctcctcaaattttgattgaggtcggtggtattggctatgaagtgcaaatgccgatgagctgtatttatgaactgccgaatattggggaagaagccatcatttatacccactttgtagttcgagaagatgcacagctactttatggctttaataccgttagcgaacgcgctctgtttcgtgaagtaatcaaagccaatggcgtagggccgaaaatggggcttgcgatcctctctggcatgacagccaatcagtttgtgacttgtgtggaaaaagaagatatctctaccctcattaaattaccgggagtcgggaagaagacggctgagcgattggtggtggaaatgaaagatcgcctgaaaggatggggagcgggtgacctctttacacctgcaaccgatgcggcccctgtcgattctacgcccgtgattgctcaaaatgctcaggaagaagccatgagcgcgctattggcgctaggttacaagccccctcaagcttccaaagcggtatcgcaagtggctaaagcaggaatgagcagtgaagagttgattcgtgaagcgctcaaatctatggtgtaacgattcacgttttgccgtcgttaaaaacagtcgccattaagccaatagagaaaatatgatagaagccgatcgtttaattgctccaatcagcaaccacttcaaagatgaggaagtgattgatcgagcgattcgtcccaaaaagcttgccgattaccaaggtcaagatcatgttcgtgatcagatggaaatcttcattcaagcggcacaaatgcgccaagaagccttagatcatctgctgattttcgggcctccgggcttgggtaaaaccaccttggccaacatagtcgctaacgaaatgggcgtgaatattcgtactacttcaggtcctgtattggaaaaagcgggagatttagcggcactgctaaccaatcttgaagaaaacgatgtgctgtttattgatgaaatccatcgtctgagcccaatggttgaggaagtactgtatcccgctatggaagattaccaactcgatatcatgattggtgaaggcccagctgcacgctcaatcaaaatcgatctccctccttttactttaattggagccaccacacgtgcaggctcgctgacttcaccactgcgtgaccgatttgggattgtgcaacgattggagtattacaaagtcgccgatttacaacacatagtgcaacgtagtgcacagtgtctcggtctttcgatggatagtgagggcgctcttgaagtggctcgccgtgcacgtggaaccccacggattgccaatcgcctgctgcgccgggtacgagattatgccgaagtaaaaggggatgggcacatttgtgcgcaaaccgctgacagggcactcaatatgcttgatgttgaccatcaaggctttgattacatggatagaaagctgctgttagcaataatggaaaagttttcaggtggcccagtcggaatcgataaccttgcggcagctattggcgaagagaaagatacgatagaagatgttcttgagccatttctcattcagcagggttatttacaacgtacaccacgcggtcgtatcgcgacagatcgcgcttatttgcatttcggtattgaaaaataatgttacaaatctcgcttgttaaaccgagcgagatactcttttttgacaaagttctcatttcttgtatttcctttcctcgctcaattgttggattttttgggtgtgatgttaatccgttgattgttttcaagcgaattacatgggttttttcacgagtaggtaacacaaattgcttgcctcttttgatttagatcattttgtttgtttattaaccacatggctggtgcgaaacttgatttagatcaaggcgtaattctcctataaaccttttgaaacaagcgggttttggcattagtattagccatagctatattagctacaacttaacaattaactaaccatagtggtacatagttgcaacaacaaattttttttgtagcaaagtgttatagtttttttaacattgtaattgttgttctatgtcgaacgtgtcattcagccgacacaaaggagttaccatgatcgatgtcgttgatttatcgcggttgcaatttgcacttactgcgatgtatcacttcctgtttgttcccctcactctagggatggcatttttacttgctatcatggagtcactctacgtcatgaccgacaagcagatttacaaggacatgaccaaattctggggtaagctgttcgggattaactttgctctaggtgtggcaacaggccttaccatggagttccagtttggtaccaactggtcttactattctcattatgtaggtgacatttttggtgctccacttgcgattgaagcgctggtagccttcttcctagaatctacatttgttggtttattcttctttgggtgggacagactttccaaacgacaacacttagtcgtgacttggttagtcgcattaggctcaaacttctctgctctgtggattctggttgcaaacggctggatgcaaaacccagtaggctcagagtttaattttgaaaccatgcgtatggaaatggtgagctttgctgatgtggtactaaacccagttgcccaagtgaagtttgttcacaccgttgcggcaggttataccacaggcgcaatgttcattttgggtatcagtgcgtactacctactgaaaggtcgtgatgttgcttttgcacgtcgttcatttgcgattgcggcatcattcggtatggcttctgtactgtccgttatcgtactgggtgatgaatcaggctatgagcttggtgaagttcagcgcgtgaaactggcggcgattgagtctgaatggcacaccgagccagcacccgcagcgttcaccttgtttggtattccaaatcaagaagaaatgcgcaccgactacgcgatcaaaattccatttgcactagggatcattgcaacacgttcacttgacgaacaagttgtaggtctgcgtgatctgcgtgatgaacacgttgagcgaattcgtaccggtatttacgcttacgatctgctagagcgtctgcgcgctggtgaaaaaacgccggaaaacatggccgcctttgatgaagtaaaacatgatctcggttatggcctacttctgaagcgttacacggataaagtgacggatgcgacagaagagcaaatccaagcggcagcggatgattctatcccaacagtatggccactattctggtctttccgcatcatggtggcttgtggctttattatgctagtggtgtttggtgccgcctttatccaaacctgtcgtcagaagattgaacagaaaaaatgggttctcaaagccgcgctattcagtattccattgccttggattgcggtcgagacaggttggtttgtcgctgaatatggccgtcaaccttgggctgtcggtgaaattcttcccgttaacgttgccgcttctgcattgagtgcaggagagatcatcacttcaatgctggcgattttggcactgtacaccatcttcttgattgcagaagtgtacttaatggttaagttcactcgtaaaggcccaagcagcctgaaaaccggacggtaccattttgaacaaggcgcagagtctgttcaggatcaagtcaaccgccaagttgaagcataaggcaaggagaaacaaccatgtttgattacgagatcttacgactcatttggtgggtactgattggtgtgctcctcgtgggttttgccatcacagatggctttgatatgggcgttggggcgctagtccctatcattggtaaaaatgataacgaacgccgagtgatgattaactctattgccccacactgggatggaaaccaagtttggctcatcacagccggtggtgctttgtttgccgcatggccgctggtttacgccacttcattttcaggtttctatctggctatgattgtgacacttgctgcgctgtggttacgccctgtcggtctagactatcgctcaaaaatcgagagcacaaaatggcgtaataactgggatttagcgatttcagcatcaggattcattccaccggttatctttggtgtggcattcggaaacctgctacaaggtgttcctttccaactgagtgatttcttgatgccgacctaccatggttcattctttggtctgctcaatccatttgctctgctctgtggtcttgtgagcttgttcatgactttgctacaaggctctgcatggctgcaaatgaaaacgacatcgcatgtacatcaacgtgctcgtaatgtggcacaactgaccggtttgctcaccgccgtgtgttttgtggccgcaggcttttgggtccagcacatcgacggttatatgattgttggtgcgattgacggtaatgccgcatcgaatccgctcaacaaagaagtgattcgtgaagcgggtgcttggttacacaactttgaacaagtaccagtactgtggttagctcctgcactgggtgtattgatgcctctactctcggttttggcgtcacgtctagataaaggtggcttggcatttttgacctctagtttaggtaacgctggcgttatctttaccgcaggtttcgctatgttcccattcgttatgccttcaagtttgaatccggcccatagcttgactatgtgggatgcaacttcaagcaagctgacgctagaactgatgactgtggttgcggttgtcatggtgcctatcattttgggttacaccatctggagttactacaaaatgtttggtcgtctcgatgataaattcatcgaagataacaagaattcactgtactaaggagcgctcattatgtggtatttcgcatggatccttggcgtattactcgcctgtgcattcggcatcatcaatgctctttggttagagcacactgagatgatggataaagatagtgagtgattggcaattaaagtggtctgaaaagatcgctcgctgtcatgacatcaccgataaggccttgctcaaggccttatcgatactattaggcttctacaatgccgcgatggtgatgtgggatccgaatagttacgcagatcgaatcggcggcttcaacgcagttattgcgccgctgatgatttgggcaatatgtgccagtatggtctttggggtagggtttaggccccgccactgggtatggcaaatcgtgttcagtccatatctatcattgaccattctgagttatttgacgttggtgcagctaataagctagctcaattcgtattgttgatgagtttttatgcagattagcgctgtcattttgagacagcgctaattttttatcattaggtaagaaaacattgcacgggcttgtactatcgtgagcgagttgcgctatagtagcagccattcctcggtgtatgagatttttatcaaaaccatgaacacttttcattggccggtcacggtgtattacgaagatactgacgctggtggagtggtttatcacgcaaattatctaaaattcttcgaaagagcccgtaccgaaatgctccgtgctgttggtgttcatcaacagagtttgttggaacaaggtattggctttgtggtcagacacatggagatcgattttcttaaaggcgctaagttagatgaccatttggaagtcgtgaccagagtgtcagaattaaaaaaagcttctttaaccttctgtcaggaactcgttaatcctgaaggcactgtgttgtctaaagccaaggttaaggtagcatgtatcgacaatgagagcatgaggccgagagctttgcctcaattaatcagtttggagttaaactgcagtgactgctgatatttcatttcttgacctttttttacaagctagcttcctagtaaaaatggtaatgctgacccttttgggaatgtcggttgcctcgtgggcggcaattatcaaacgtagtaaagttatctctgctgccgagcgtgaagcggatacctttgaagaccgcttttggtctggaatggatctcggtgcgctataccaagacgtcaaaaaacgtaaagatgacatctatggcattgaggaaattttttatgctggctttactgaatttgctcgtttacgtaagactaacccaggtgcacctgattttgtgatggaaggcacagggcgagccatgcgcgtagctgtggctcgtgaagttgattcactcgaaaccagcttacctttcttggcaactgtcggttccatcagcccatatatcggtctatttggaacggtgtggggtatcatgcatgcgtttattgctcttggagaggtaaagcaagctacgttagcgatggtggctccggggattgcagaagctctaattgcaacggcgattggtctatttgctgcgattccagccgttatggcttacaaccgtcttagcaataaagtcagtaagcttgaacatacttacgctaccttctcggaagagtttcataccattctccaccgtcaagtgatggctggcagggaataactatggctggctatcaaaccaaaaaacgtgagatgaaagcagagattaacgtggttccttacatcgacgttatgctggttctcctcattatttttatggtgacatcaccgtttgtaacacaaggtgtggatgtggagttgccgaaaactcattcggctaaatcagcacaagatctagcgggtgatagcgattctagctttatcattgttgagattgataaagaaggtaatcttggcctgagtgttaatgatgaagaagttcaacgcggtctatccatcgaagatgtgattgttcgagtgaaagcagaattgtctcttaaacctaattcacctgtggccgtgggtggcgatgccgctacaccttacgcagagattgttttggtattggatgagttgggtcaagctggtattcctaaagtagggctactcacggaccttaaataataggtttaatactgagcatgaaagagaataagtccagaaaaagtaatgatgctaaatcgataactatttcgctggcgatgcacggtgctttggtcgcgatattgctctggggagccgatttcaccatgtctgatcctgaaccgacaggacagatgattgaggcggttgtcattgatcctcagctcgttcgtcagcaagctcagcaaattcgtagtcagcgtgaagaggcggcgaaaaaagagcaagagcgactggataaactccgtcgtgaaagcgaacagctagagaaaaatcgacaagcagaagaagagcggatccgccagttgaaagagcaacaggctaaagaagccaaagcggctcgtgaagcggaaaagttgcgtgagcagaaagaacaagagcgcttagctgctgagcagaaagctcgcgaagaaaaagagcgtgctgcaaaagcagaggctgaacgcaaagtgaaagaagaagccgcaaaaaaagctgagcaagaacgcgtggcgaaagaagccgcagcagcaaaggcagaacagcaacgtattgaacgtgaaaaagaagccaagcttgcggaagaaaaagccaaacgtgaaaaagaagtggcagcgaaagctgagcaagaacgtttagcaaaggaaaaagcggccaaagaggcggcagataaagccaagaaagaaaaagaacgcgcggcaaaagcagaagctgaacgtaaagctcaagaagcggccttgaatgatatttttggcagcttgagtgaagaaagtcagcaaaataatgcggcacgtcagcagtttgttacttcggaagtagggcgctatggagccatctacacccagctcatccggcagaatctgttagtggaagacagttttcgaggaaagcagtgtagggtaaacctaaagcttattcctactgggactggcgcattactgggtagcttaaccgttttggatggtgacagtcgtttatgtgcagcaaccaaacgcgctgttgcccaagtgaatagttttccattgccgaaagatcaacctgacgttgtggaaaaactaaagaatattaatttaaccgtagcacctgaataaggaagggaaggcttgtgtttaagcgattagtttttgttttgatgctcatcggtaccggtttttccaatattgcgaatgcagcattggagctagttattactgacggtattgattctgcacgtccgattgcgatagttcctttcaaatgggaaggcgcaaccaagttgcctgaagacgtttctgcggtgattgcctctgacttacagcgcagtggtaaatttagcccagttccgaccagcaaaatgccacagacgccttatagcgaagagcaggttaactttggcaaatggacatctatgggggtcgattcattattgacgggtacgatcacgcaaaatgcggaaggtagctatgtaattagttatcaactggttgacattgtgcgtggacaactgactcaaggccaaagcaaagctctgtctcaagatggtcaattggtgctatctaaagatcatgttttgtttaataaagtggcgaccgttcctgcatcaagaatgcgtgaatatgcccaccgtattgcggacttggtttatgaggaattgaccggtgaacgcggcgccttcttaacgcgcatcgcttacgttgtggtcaatgataaggatccgtatccttatcaactgagaattgctgattatgacggctataacgaacgtcttgtacttcgttctaagcagccgcttatgtcacctgcttggtcacctgatggtcagactttggcttacgtgagtttccaaaacggacaagccgaaatttacatgatgaacatctacagtgggaagcgagagaagctgacgtcattcccacgtcataatggtgcacccagattctcaccagatggtaaaacgctagcgctggttttatcaaaaactggtaatttacaggtctacacgatggacttggctacacgtcgcttaacagaggtgactagtggccgttccaacaacaccgaacctttctggcatccagatggtaaatctttaattttcacttcagatcggggtggtaaaccacagatttatcaagtaaatttatccggcggtgaaaccaagcgtttaacttggcaaggtagccaaaacttgggtggccaaattacaccggatggaaaattcttggtgatggtgaatcgtagtgattccggcttcaatctcgcgaagcaggatttagaaacaggggcaatgcagattctgacaaaaaccttgttagatgagtccccaagtattgcgccgaatggtggtatggtgatttatagctccatctacaataaggccaacgtcttgtcgatggtatccattgatggacgctttaaagcaagattaccggcaaccaatgggcgcgttcgtgctccagcatggtcaccgtttttataacaagtaactgtttaatagaaaggaataggaaatgcaacttaacaaagttcttaagagtctgctgattgcgctaccagttttagctgttaccgcttgtagctcaagtgatgatgctgcgaactcaggttctcaaactaaccaatcagcagtgtctactgttgactcaaatggtctgaatgcacaaggtcaactgactgagcaagaactgaaagaacaagctctgcgtgaaaaccaaactatctacttcgcattcgacaacgcaactatcgcgagcgactacgaagcaatgctagctgcacacgctgcttacctagtgaaaaacccaagcctacgcgtaactatcgaaggtcacgctgatgagcgcggtactcctgagtacaacatcgcactgggtgagcgtcgtgctcaagcagttgctaagtacctagaagctctgggtgttcaagctggccaactgtctatcgttagctacggtgaagagaagcctctagttctaggtcaatcagaagaagcgtacgcgaaaaaccgtcgtgcagttctggtttactaattgaggtgatgcctcatgttcagtaacttaaagcacgttgtcatgctgatgttactggcaagtgcagcgagctatgcgctcgctgcacccgctccagtatctgacttaggtagcaacgtatccggtggttcgcggagttcagaaattgaacgtctcgaacgtctcctcgaaagccgtaatcttgtgcagttgcaaatgcaaaagcaactcgatgatatggcacttgaagtcaatgaattacggggccagattgaaaaaaacaactatgacatgcagcaaatgttgcagcgtcaaagggagttgtttgtagaacttgaccgtgtgcgtggcgagatgaagtcaccttcctccggagccggccaactaccaacaagcagcaatgatgaggctgcacaaggcaccttcagtagcgacgctaatgaacaggctgcttatcagaatgctgttgatctgatccttaaaaagcgtgactacgcaggtgcgattgccgctttccagaagtttcagactgactaccctaattcgaccttctctgctaatgctcactactggctaggccagctctattttgccaagaaagaagacaaagaagccgcgaaaagttttgcagctgttgtctcggataaaggctctaacaaacgggctgatgcattagttaagttgggcgatattgcgaaacgcaataataacgccgagcaggcacgtaaattttaccagcaagcggtggatgaatatcccgatagtgcttctgctaaaattgccaaagaaaaccttaaataaatacaagagctgcgaatgcagctcttgttcgtttcagcttttcactctgttatggacagggtcattcatcgctacacattatttctccctccttgtttagggcattcaattttgcttgctgctggctagggtgtacaatgcgccgtctatggaagttgtgtagagcaagagcaatgagccacatactcgatactataaatacagtttatccctttcccccaaaacctatccctcttagggatgaggaaaagcaagcttatatcgctgagatcaaacaactcttaattgagaaagatgcggtgttgattgctcattactatacggatcctgaaattcaagcgcttgctgaatcgacaggtgggtttgtgggtgactcgctagagatggcaaaatttggcaaccgctatccagccacaaccttaattattgcgggcgtacgtttcatgggagagtcagcaaagattttgaccccagaaaaacgcatcttaatgccgacgctcgaagcggagtgctccctcgatcttggttgcccagcagacaagttcactgagttttgcgatgcacaccctgatcatacggtagtcgtgtatgccaatacgtcagcggcggtgaaagcgcgtgccgactgggtagtgacatcaagcattgctctggaaattgttgagcacttagattctgagggtaaacctattatttggggtccagatcgacacttaggtgcttatattgctaagaaaacgggcgcagacatgctgttatggcagggcgaatgtgtcgtgcatgatgagttttctgctgatgctctgcgtaagatgaaggcactttatcctgatgctgcgattttggttcatcctgaatcgcctgcgagtgttgttgaattggcggatgcggtaggctcaacaagccaactcattaaagcggctaagacattaccacagcagaaaatgattgttgctacggataaaggaattttctttaaaatgcagcaaatggttcccgagaaggagctgattgaagctccaaccgcaggtgcgggagcgacttgccgtagttgtgcgcattgtccttggatggcgatgaatggccttcaggctattgcacaagcactgcgtgaaggtggcaaacagcatgaaatttttgtggatgaagcgctgagagtgaaatcacttatcccgcttaatcgtatgttggatttcgctgaacaactgaatttaaaagtgaaaggcaacgcgtaagtaagctgtctgttgtgctgaaaatagacatgcccatcgaaaaaaaaacgggcatgtctagcaaacatgatggctactgagcttcagctaacgtgacaccacgttgtgtgattccacacaacatcactggaatcgcatgataaatttcagcaaattgctctaaaccggtgaagccttgctcataaagtgtggcgatcgatgtttcaggatcgtagagcatacttaatgaaagaagcacgccaccaagcagggtattatcggaactattttctggcatcaacacctcccaatcatcacgcgctaattgccaaccttgtagcatcccctcgcaaaaatcacgtacctcttgattcacgatttctgcctcatccaacaagtagccagttggccattgccagttgccttctagtagctgagatcgtgtttcattccaaagtgcgatgatgtgctcgaaatagttttctaattggataggatccgaaaaaggtgcaatctcttctccaccccataagaaggggagccattcttcagggggtaagacattaggacagcaagccatagcggtaacaaaaccgacggttttagcttgattgaggagtttgttttctaattctggctgctgcaggatttcttgtaaggtttgcatgagatgtgagtgctcaataaatatcagtgcgcctattttatctggaaagcgtgctcagggcatccgcttgttctctctgttcagcgtttaaggctcaatttcctgcctaagaatgttagtttgtgcacagcgccatggaaaatcgatgagaaaagaaagcctgacagaataatttcgctataattttgtaaacaaaaaataattcagttggttatggctattcgctcctcgcttaaaaagaaaagtattctagcgctgaccatttatttggccttcttccttgcgattgtaggaacgctgagttattgggggcttgaagtcccatttagaaaagagctgaaaaataatctagccctgagagcggagttactggctacccaaattcgtgagccattgaataactcgataggggttctgcagagtcttaccagcattggcaaaagcgcagccgataaggaagagcaagagcgcatgctgcgctcactattttctgttgttggcggagtgatcattagcggcgggttgtggccggaacccaatctatcggcaactgacccctcactacgatatgacagcttgttttttaataaagcaaccgatggacaggttgaccaactgagctcatggaataaccccaaagccggggggtatgaccgagaaagctggtacttggctgcagaacgtgaagccgaagggctctatttctggtcacctgtctatgttgacccctatacccgtgtggaaatgatcacggtctcgaccccttattatcgtaacggtcagtttgcgggcgttgctaccgttgatctctcacttgaaagcttaatccaattcgttgctgcgacagcagagcagtacaacttaggtgtgaatcttaaagatgcctttggggttgaggtcgtctcacataacttccgcacttatgataatgcgttggtcagttactatagttttggcgagttcaattggcagattgaagtggtgaatgctaatcagcatgtcgatgaaatcatcttcgacttaattatcaacatcgaaaaaggattgatgccgatcctgctgctctgtgtgatggtggggtattttttaattagccattattggatccgcccaattgtcttaattgcgaaaaaggtgagtgagtcgagagaaggtgaaatcatcgatattcggtacaaatctcaggatgagatccgccatcttattgatacgtttaaccaaaaaacgatttacttagaggcagagaaagtcaaagctcaggcctcgaccaaagcaaaaagtgcatttttagccacgctctctcatgaaattcgaacgccgatgaatggcgtgctcggtaccgcgcaaatcctattgaaagatgaattgacctctaagcagcgacagcacttaaccagtctctacgaatcgggcgaacatatgatgtcattgctcaatgagattttagattattcaaaaatagagcaaggcaaattcgagttggatcacagcgcatttccgctcaaatcgatcatcggcagcatcaaaagtatctactccagtctttgtgttgaaaaaggactgaaattccaactgaactcagaaattaccgatggacgatggtactacggagacaaggcgcgtttgcggcaaattatcttcaatctgcttagtaatgcggtgaaatttaccgaagcaggctttgtcgcaatagggttaagtgaagaaagctgtgacgaagagaattacttgatcatcaaagtgcaggatacggggatcggcatcgcgcaagagtcgttagggcgtatctttcgaccctttgaacaggcggaatcacacacaacacggcgttttggtggtacaggcttaggcttggctattgttaaacagattgcggaattaatgaatggcactgttttagtgcaaagtgaagttgggcagggttcttgttttaaggtgagagttaaattagcgattaccgaaccagtaaccgaagatgtgaaacctactaaagccaaaacgtatcccggtttacgggtgctgattgtcgaagataaccgtacgaacatcatgattctggaagcttttatgcgcaataaaggttttgagtgccatagcgtgatggatggtgtacaagcgattaccgcgttacaggaaagctcatttgatctcgttttaatggataaccacatgccgttaaaagatggcatccaagccaccagagaaattcgtcagttgccactgccgcaagccaagatactgttgtttggttgtaccgcagatgttttcaaagatacccgggataaaatgctctctgcaggggcagatgacattatcgctaaacccattgcagagcatgagctagatatggcgcttgaacaacactcagagcgcttgtaccagtttcatcgcgaaccatctttaccatcggtagagtaaatcactctgtttcttccttctttctttcctttcttatgcgtgtggccaagttcggctggcaagaaactgtctcaccgtgctcatcgtgatgtaataaaattaccaaacgtaaacttagaaaccgatgttttgactaagaacgcgtaaaagtagctgtagatgctattttaattactttttttggttttttatttaccgtgcgagtttaaaaacaaagcctaaaactgaattttgtatggtttaattgttccataaactgccaatttggaattatggcagtgacatgtttggtcatggttgcaaaattgtagtgatatattttataggggatgtaaatgaaagctcgtggtccgttttgtattcgtcatgcagcggctgatacttttgcgatggtcgtcttttgttttgtaacaggcatgattattgaaatttttgtgtcaggaatgacctttcagcaatcactcgcttcccgaaccctttccattcccgttaatatcgcgattgcttggccgtatggtgtgtttagagattatgttcttcgccaagggcgcaaaatttccccaaccggttggatgaaaaatctctccgatctcgtggcttacgttctctttcaatcgccagtttatgccgccattctcttcaccgtaggtgcttctaccgatcaaatcattactgctgtggccaccaatgcattggtgtcgtgtggaatgggggtgttgtacggctatttcctcgatatgtgccgccgctggtttaaagttccgggctatacagtatctgagggttaatgcggttaaacatttgccctgttaactgcccctccatttaatttggccaatttcagttattaccctaaatcgagcaatcgaatcttgggaataagtaaaactggccttttgggctaatgctaggcgctaaaagctcttgccacacgaccattacactcaatggtgtactgctcagcataagccggaataaagacagattgtccttttcgtacaaggcattgctcaccatttgcatgtcgcaatatcattgaagaatcgagaggcagcacaacttctgcactcttaacgccgatagtctgctgagtcgtaggtgggatgatggcaaatttaaaatcggcaactgggatcggatattgttcacacccttcaatgacttcaggcttaaggcgtagttgttcaagtggcttatgtttgaactgagtacatgccaccaattcatcaatatccatgtattttggtgttaaacccgcgcgcaacacgttgtcggagttggccataatctcaaggcctgttccgtgtaaatacgcgtgcggcgtttctgcgtctaaaaacatcgcttcacctggttgtaaggtaatcacattgagcatcagaggagcgaataaaccaatgtcattgggatattggttttccaattcgacgatcagctggaaaagaggcagatcaatctgcttagcttgagccatcaaagcttcaagcgcacggtttttggcttctccctgtaatgagagtaaccctgagaaaaagtctctgagcccttgttctgtcggatttgattggaatacgttaacgagaggctggatctcatctatcgataactcaataaagtagttaaggatttcctgattggcacgaaagccgttcattgcttggtactcggtgagcgcataaaccaattcgggtttgtgattggggtctttgtaatttcgttgagcagccgtgagcgcaatgcctaattgttcctcttgggcgaaacctcgttccgcttgctgtttgttcggatggacctgaatggagagggctttttccgccgccaaaattttaaacaaataagggagttcgccgaactgccgcgcggtatattcacccaaaatcaagtttggattttgcgcaataaagtcggaaagttgaacgattttgccgttaatggctataccggagcagccattaggatgagcgcccatccatagctctgcttgggggtcatcgtttgggttttcgagttcaaacaactgctgcaaagcggttttactgccccatgcgtagttttggatagggttggtcatcgggaagaatactgcctctggtagggctgcatcctgagtcggaatctgagtcattgtcgtcaccgttagaaagatggcttgagtggaacctcaagccataacgaggaagggagaattaagccgcagcggcttcaaacttttgtgagcggatttttttgagcgtcacacaggtgatggcggtgacacccgcaccagccgccatacaaagtagggcaagcagtgggtagttcattgcgccaagcagggcgactacggggccaccgtgagccacactgttggtgatgccaaaagagaatgccatgacagcggcaaccatagagcccaacacgttggctggaatgactgacattgggtcttgcgccgcaaaaggaatcgcgccttcagagataccgactaagcccattgcgcctgcggctttacctgcttcaagctcagaagactcaaacagttcgagcttacgacccatcgctgttgcgagtgccataccaagtggtgcaacgggaatcgcacaggccatcgcacccataaattgagtttggccgctggcaatcatgcctacagagaataggaaagcgactttgttgaatgggcctcccatatcaaagcctgccatgccaccgagtacgatgccgagcagaataacgttgccggaactcatgctagtcagtagagcagtgaggccatccatcaggctcgcaatgggagcgccaataacgaaaatgaacagaccagcgatgaacagcgatgccgtgatcggcgcgatcatgatcggcactaggggttggataaacttgtgatagttaatggaagtaatccacttcacgaaataaccgaccaagagacccgcaatgatggcaccgataaaccctgtacctgcgtcagcaccataaaaagagccgttattggcaatccagccaccaatcaaaccgggagagagcgcagggcgatcggcaatggcgtaggcgatgtagccggcaaggatgggaatcatcaaggtaaaggccactacgcccacttcaaggatttggttccacatactgcccgctggaatggccatacccgcttcagttggctcaccacccaccgcgagagccagtgcaattaaaagcccgccagttaccacaaatgggatcatgtgcgaaacgccattcatcaaaaagcgatacaaatccgagcgagcttgtgaggctttgtttgccaccgattgagccttaaccgtttcagcttgataagttggcgcccttagcgcttcattaatcagcttttgtgcatcacgaattggcgctttcacatttgttttgatgaggcgtttgccggcaaagcgtgccatgtcgacttgtttatcacaggcgaccacaatcgcttcagcgcgttcaatttcttccgcacttgggctatttttcaccccaatcgagccattggtttccactttgatctcaaaacccaaagccgccgcgcctttttccagtgcttcagccgcaaggtaagtgtgagcaatacctgccgggcaaccggtaacaccgataatcagccctttgctttctgcttggtttgcaagaggtgtaggcgcggattttttcagcagtaattctagtgcttgctctgagtttttggtgttgagaaaagcctcgataaaaccttcttcaatcagtttggaagagagttcggccagcacttcaatgtggtggttatcgccgccatcgggggaggcgatcatgaaaaaaagcttggaaggcaaaccatcttctgcgccatagtcgataccctctcggctgacaccaattgcaacagctggttgagtcaccgctgcacttttagcatgcggaatagcgacaccatcttcaaatccggtattacctaactcttcacgagcttgaatatcttttaagaatgccgctttatctgaaattcgcccttgggcatgtagaatatttatcagttcttcaaatacggcttgtttggaattcgcttgcagatcaagctgaattaaatcggcattaatcaattggttgatcatagagacctctgtacattttatttttatgtcagagttattctttaatttttttatttttcttattagtgcagaaataaaacattcactagaggattgtaactctattggtttggtgtgatttagatctcgtagcgtctattggggtagtgaggccaattttaagtaatgattgtaggtttaactcattaattttcatttagttatattatgtttgttgttattcatggtggaggtttgtgctagagaattggtgttaaaactggattattgtatcattctgtcttgagtgtgatgttgctcaaagagactcaatggcattcggggtatatctgacgttaataaaagtgcgatgacgaagtgagggtttacatatgatatttgatgatttgatttcctcggtgcttaatgagcgtgaatcatttcatcatatttggtttgcgggtgattttcatacaccgcctgaattcagttatcaggtgaattttccacgcttagaattggtcttaggtggagagtatataaatgaaatggaaagtcatgaccgtaaagtcacgaaaataattgccaaagccggagatgcgatttttattcccgctaactgttggaataaaccgaactgggataccgattgctcagtgttgagcatgttatttggacgccgccaactaggactgagttttgtcagtaagcgcaaaggcgaagccaacttttatgatattcaaaagcacagtatccaaacgcgctcagggtttgctattgataacatcttagaagcgctcagctcattggcgcgtgagaattataaaaaaccgatggatgagctgttgctgcaagctctccttcaatatacccagacgatgttgaatgcgccgacagagcagccacaaaaccgagtgcaggatctctaccaagggatctgtatctatatccaagagaattttcaccgcccgatcacgcgagaaagtattgcttcgcgttttagtatctctgccaaccatttatcgaggctgtttcgccagcaagggcatatgaccttggccgattacattacgtgggtcagggttgatagagcaaaatttatgctgaaaaagtacaattttaagctcaatgaagtgtcgctacgttgtgggtttaaagatgtgaattacttctgccgcgttttcaaaaatcgtacaggccgtacaccaacggattatcgtgcttcaatttaacaggcgtgacatcgcgtacatcagtagagcttgtaaatcaacgccgctgcgtgtcagtagtaaacgttctaccatttgatcgcacagtaaatttcgggtcaggttggttgcggtaatgatttgatctcgattgggcttactcggcatcaccaaagcaatcgctaaatgcacctctcccatttgagaggcccaatccatcgcctcatcattcttaataacggcaaccgcaatgtgttctatgtctgcaaacatcacatggggaatagcaatcccaggagctacgcaggtggaagagcgttcttcacgtttgataaaagccaaaatcaactcatcgggtgaaacggggtagatcagttgcgctaaccctttcaaacactcaaatttggtgagttcagtgtgggctttggcatagtgccatttgacctcactcggcgggcatatttgtggcaggcgttcggcgagcaggctagagaactcatagttgattttggagcccacgacagtgtaatgcgcagaaagcatgtctttaatcacgaaacaggcgagttcagcatcaataccgatggcggtgatttggcataaatcaccttcttgtaatcccacctgcaataccgcgagagatttggtgagttcagcactgcggtttctggtgatgttgatgatatgcagggtgcttttgaacttacgcgcaacgcgagacagcggttgggcaacatggacgctggcattcacatcattcaccaagaaggtgacttggaattcatgcatcatgccaaggatcagcgacagtggacgagaaagactttatcgacattgagtagcacttcttcgatcgagagcttcaccaccttcatcccttcaaatcgtgcaggctgttcgatgtcgatatcggagacgatcaacaccttatcggcatgggagaggtcataaggtgtgagaggattctcgatacccatcgcaccttgagtttccactttgatctgcacattgtactttggtgcggctttggtcaaagcatcggccgccatataagtatgagcaatgcccgttgggcaggcggtgaccgcaacaattttcatggaaatccctcattgttatttttgcggcgatagtaacatagcgcttggcaaatactccgttttcggccaagacccagttcacagttcaaatcgaatgttacattaatccagttattgcatcttttgtcctgtgtcttgaaagagtatcgctcgttactctagcgaggcgcatcggtatggcaatgccaattcaaacaacagtaaggtaaaacaattgtggatattacccatctgatcgaacctgaaatcatctgtttagatctaaaagccaataacaaagaagatgttctgattgagctggttgagttgctcgataacgcaggaaagttgaccgataagcagcaatttttaaacgacatttggcgacgagaagagatcggaaatacagggtttgaagaaggaatagccattccacacgccaaaagtgctgcggtggcgttgcctgcagtcgtcgtgggtattagccgccaagggatcgattacggtgcagaagatggtcagctttctgatgtgttttttatgctggcatcaccggatggagaagatcatcaccacattgaagtattggcacaaatctccagtaaattgattgaagagggatttgttgaacagctcaaagccgcagaaagtgttgagcaggcactcgccctttttattcacccacagcactcaacattaagctctacacaggtaatggattatgccgattaccagccgctaagcccaatggcacaaagattagctcgcgttaaagagcatctattatttggtacctctcacatgatgccgtttatcgtggcgggtggggtattactctcgctttcagtgatgatgtctggtcacggagcggtgccagaagagggcgtgttggcggatatcgctcaaatgggtattgccggtttaaccctatttacggtggtattgggtggttatatcgcttactcgatggcagataaacccggtttggcccccggcatgattggcacctggattgcgataaaccaatatcaaaccggctttattggcgcgatcatcgtgggtttttttgcaggctttgtggttcgtcagctgaaaagaatcgctctccccgacagcatgagttcgctgggttccatcttcatctatccgctggtggggacgtttgtaacctgtggtgctgtgatgtggttaatcggtgcaccgattgccagcagtatgctgtggctcaatcaatttttggcatcgatggccgattccggcaaagtggtgctcggagcggtattgggggcgatgactgcctttgacatgggcggcccaatcaataaagtcgccacgctgtttgcccaaactcaagtcaacacccaaccttggctaatgggtggggtggggattgccatttgtaccccaccattggggatggcgcttgcgaccttattgtcaccaagtaaattcaaacgggatgaacgtgaagccggaaaagcggcaggcatcatgggtatgattggcattagtgaaggggcgattccgtttgccgccgctgatcccgcgcgcgtactccctgcaattattgcgggtggtattgttggcaacgtgattggttttctctttcaagtgctcaatcatgccccttggggcggttggattgtgctgcccgttgtggacggcaagttagggtatattcttggcactatcgccggtgcattagccacggcactgattgctattgccctgaagaaaacggtgcatgagcaggacaatgagcaggggcagtcacttgctttttcatcggttattggagaagggcaagccgacattcttgccgtcacctcgtgcccttctggcgttgctcatacgtttttagcggctaaatcacttgaaaaagccgcctgtctggcgggagtgaaaatcaaagtagaaacacaaggcgccaacggtatcatcaatcgaatcacggccaaagatgtgcaacgagcgaagctggtgatctttgcgcacgatgtggcgattaaagaaccagaacgcttcaagcacattaaagtcattgacgtgacaacgaaagacgcgattttaaatgccgcggcattggtgcagataaagcgataacattctgaatcactacacttgagatagaaaatgagccctttgggggaaagggctctgggggaggagcttaaggtttaagcttggataagttcggcggcttttttcatcgcctccttggtcgagcattcgatgactttcgcgttggcaaagcggtgagcatctttcacttggatatcgtgagcgaggataactagcttcgcgtttgcgacatctaggtcagtgatgcggtttttaatgccattttgaccttgcgtttcgactttgattttgctgccagcggctgcgcctgctttctcaagtgctttggctgccatgaaagtgtgtgctacaccagatgggcaacaggtgacagcaacgatatcgtactcgccttcgccggctgctggagccgcttgagcttgcgttggtgcagcttctgcgatttcgtcttccacttcttcttccgcgactggtttccagaagccaacgatgagtgcagtggtgagtgagcctagtgcgatacctacaacgtacattggaatgttgcttgataccggtgctgtgatgagaccgccccaaggagcatgaagcagaacgttagtcaggaagccaaacacacagccaacgataccaccagcaacgatggaaggaagcacgcgcattgggtcatttgctgcgaatgggatagcgccttcagagataccgatagaacccatgattgctgctgctttacctgcttcttgttcttgtttggtgaattttttcttgaacaggaacgtggctagcgccatgccgagaggaggcgtacagattgcgatgcccacaccacccattagccatggttgagtatccacttgagtttgagcgaatagcgttgcgaccttgttgattggaccgcccatatcgaatgccgtcataccaccaagaatcgcacctaacaccactttagaagcgccagccatagaagctaggaattcgttcatagacgccatgaacagtttgattggctcaccgataccccataaaacgatgcctgcggagataagtgtaccgataagtgggtagatgaagtaagcgcccaacgcagtcatgttagccgaaagagggatcttcttaagttggaataccacaccaccggcgatgaagcccgctacgatacaaccaaggaaaccgccgcccatatccgccatgatgccagaagagatcatcgctggcgcaagagctggtttgtctgcaatggaataaccgatgaaaccacccaaaataatcgggaacagcaccagacctttaataccgatattggaaatatccgctaataagccatcggcaggaacggcacctttgccggatgccattaccgcaagtgccaataatacgccgccagcaacaataaatggcaacatatgtgaggtgccaaataaaaggtggcctttcatggtactgaggagttttttgaaattgctactattattggtagcttgagcggttagggtactcataatttcacgccttatgattgaattgaaatattaaggatctgatgttcattttttgcgttatgaatatcttcaataaattcttcgctaaattttccgaataattcttgaagaacataaatatggtggtctgcgccgttgtcgggagaggcaatcatgaagaatacggtcggtttgatgccttcttcatctccatattcaatgccttcgtgctttacaccaacagcgatggcaggttttgtaacggctttactttttgagtgtgggtaggcgatgccgtccattgacgtgacacttaatctttcacgtatttcaatgtcgtttaaaaaatcctctttgttactgatgcggttattctcaagtaacatttgcgccaattctgcaaaaacttcatttttactatttgcttgaagattgcctttaattaaatggatgttggtgagctcggtgatcatttattggctcataaagtatttaactgatgagctaaaattaatggatgtcgagttttactgaaatagcaaaaataattcactcactatagatttgtaccacacatgattaagtgtgatattcatcgttatatatctttccttcttgaagtggcagcggtgttggctacgttcgttcacctcaatcacatcgtttatctatgctcatcgggattaactaacaggctgtttccctacaacgccaattcgtaaaaacattggaatggatccaaaatgaaaaacccagcttcgctgaaacgaggctgggtttggggtattaactgaatattaagcttttagaagaaaccgagaggattcacatcgtagctgatcagtaagtttttggtgttctggtagtggttcaacatcattttgtgggtttcacgcccaatacccgattttttatagccaccaaaggccgcatgcgcggggtaagcgtggtaacagttgatccagatcctgcctgcttgaatatttcttcccatacggtaggcgaggttttggtcacgagtccaaatacctgcgccgaggccgtattcggtatcgttagccaatgccaacgcttcggcttcgtctttaaaagaggtaatggcaatcacaggaccaaaaatctcttcttggaagactcgcatcttgttgtggccttgcagtagggtcggctgaatatagtagccttgaccgagttccccttcctgtttggcaacgccaccaccaaacagcacttttgcgccctcctggcggccaatatctaagtaactcaagatcttgtcaaactgctcttgagatgcttgagcccctacttgagtagcggtatccagtggattgccttgtttgatgcctttcgcccgctccgcgactttggccacaaagcgatcgtaaattgactcatgaaccagaacgcgagaagggcaagtacacacttcgccttggttgaaaaagcccagcaaagtaccttcgatacatttctctaaataggtgtcttcgtggtcaaaaatatctgggaaatagatattaggagacttcccaccgagctctacggttgatggaattaaactctgcgccgcacatttgagaatgtgttgacccacttgggttgagcccgtaaacgccagtttggcaatacgttgactggtggccaaggcttggcctgcttcactgccaaaaccgttgaccacgttgagcacgcctgctgggatgagatcggcgattttttcgatcaacaccaagatcgaagtaggggtttgctcggcaggtttgagtaccacacagcagcctgcagcaagggctggcgctaacttccacgctgccatcagcattgggaaattccaaggaatgatttgtcccaccactccgattggctcaggaaaatggtaactggccgtgtggctatcgagctcagcggcgctgccttcttgagcacgaatacagcctgcaaaataccggaaatggtcaaccaccagagggaggtcggccgctagagtttcacgcacaggtttaccattctcccagcattccgctaccgcaagctgctctatgtttgcttcaatccgatcagcaattttcagtagcaggttagagcgctcagtcacactggtttttgcccatgcttcacgcacttgatgtgcggcatctaacgccaaatcaatatctgcttgggttgagcgagcgacttggcaataaacctgtccattgacgggtgaaatattaccaaagtattcgccactgacaggtttaacccattggccgccaatgaaattatcgtaatggctcttgaaggtgataacggcgttgtcactacccggttgtgcataaatcataactcgtccttttgttttcggtttgggtgttacacagtgtcgaaatgcactgctttatccctttcctacttgaagtggcaactccaagtggttcgggtattccaacgcgataacgcaaatcacaggccaacataaatgaacttgttgttaatcttgtgtaacgctatggttaacaaaaggatcgcaagtaacagacaaggttgccgtactcgattggatgatgtgtacgagtgttcaagtgttacaaaatgacacacccagagtgtgaggaaatggaacagtgatgcaacttcaacagcttagccatgttaattggctggtgaactcttggcagcgtagtgaacaggcggggttgacccagcagagtcgtgcgcaagatattcgcttgagtgacaacaaacttaaggagcgtcgccaagagctcgcggggctgattgacacggtcagccgatttgcactaccgctgttctaccaactgtttgcacacagtgacagccgtttaattttgaccgaccaacacggcgtgatcatcggcagttgggggcaagcgagatttcgtgaaaaactgagccaaatcgcgctaagctccggcgcatgttggcaagagccgatcaaaggtaccaacgctattggcacggctttgattgagcaaaaacccatttcggtgattggtgagcagcactttattcagcatcatcactttatcagttgttccgcgagcccgatttttgattacaccggacagctgatcggagtgttagacatcaccagcgagcagcagaaacacacgctttcaacccaagttgtggtgcagaatatggtacaactggttgaaaatcagctccttaaccagataccacatggccatgtacgaatcgatctcgcctgtgaaccctcgttactgagcagtggctggcaaggcgtaattattgcggatgaatcgggccagatattggcgcataaccaagtcgcaggtcagttattagcgcaaggcagagtgattggtcaatcggtggagcaggtgctgccacggccacagacgcatgcatcatttatctataccaccacaccgctccactccaaacaacatcgtacccgcgcgttaacccccgccagtgatctgcattttggggatgcggaggtggagcgctgttggcaacaggctaatcgggtaattgataaagatatccgcttgctgatccttggccaaactggggtgggtaaaaatgaatttgttaaagcgctgcacaaaaatagccagcgtaaaaatggtcctttagtcgcggtaaattgtggtgcgctggccaaggagctggtggaggcggagctgtttggctatgtcgctggcgcctttaccggagccagtcataaaggttaccaagggaaagtgcgtttagccgacaaaggcattttgtttctggatgaaatcgctgatttacctctagatgcgcaaagtcgcttactgcatgtgttgcaagacaaaaccgtgctgccggtgggttctaatcacgccaccaaagtcgacattcagattattgctgcgactcacaaaaaccttgaacagttggtcacacaagggctgtttcgccaagatctctactaccgactcagtgatttggttgtcgagctgcccagcttccagcagcgtcaagatagacaagccctaatccaccatattcatcgccgctacagtgatgctggccaacaaatctgtggtgacttgatgcaaaggctactcgcttatcactggccgggtaatttacgcgagctagatagcctaatcaaagtcgcgagtttgatggccgaaggcgagggggtactcactttcaatcatctgccgacacatcttgcccaaaaactcagccacgcggcgcctaccgctacggaggatgatcaacagaaagacatcaaatccacggtagaagcatccttactcaagacctaccaagcaacgcaaggcaacattagccaaacctcgcgtttgcttgggctgagcagaaataccatctatcgcaaattgaaagcgctggggatactgaagtaagattggcggcttcacgttaccaagggtgggcgcagcttcatcgcctattcccattttctgcctgatgaaaggcagattttcacagagaaccctctaatgaaccaacaagttaacaacccgctacacggcctaagcctagaaaaaatcgtcactcgcttggtggagcattatggctggagtgggttacatcagcgtatcaacatcaactgctttgcaaatgacccatcgattaaatcatcgctcaagtttttgcgtaaaactcaatgggcgcgcgataaggttgaggcgctgtatctatccacctttagctaatccctacgctttaccaaggcagcgtctgaccatcgtaggcataaaatccgccgctttgttcaggcgttgccgctgcaatcaaaccaatcaaatcgtgcgcaacacgggcggggctgaacagtttatctggggcaacattgctgtgaaacggcgctgagagtttggtgtcggtcgtgccgggatgcagtgccaacaccaccccttttttcagtgagcgttgccattcaatcgctaacgttttcagcagcatattgagcgccgctttcgatgctcgatagctgtaccaaccgccgagttggttatcacaaatactgccgaccttggcggaaagcgtggcaaacttggccgcctcactctgcttcagtttggcggtgaaatgcttggcaagcagtaggctaggcaaggcattgtggatcaggttgtagaggaaaaaatccgcatctaaggcattgaggttcttttctggtcctttacttgctgtatgcagtacgccgacacagttgataagccaatcgacttggctaaattgctcactcagagcttgtacctgcgcttcttgggtggcatcgagtgcgtgccaagtcagccgcgggtgctgccacgtcggcgtagtactatggtaagtcgcatgcacgttggcctcactaaaacggttcagcgcttcttgcaccatcgccaaaccaataccgccgctgccaccgatgatcacgatattcatgatgagctttccttattttgaggatgatggataagaagatacgcgctggcggcgattggccagtcaaccatatcgacactgtcgagcgccaaattttcgagagcatttagcttgtcacaagccgttccgcaccatttggcaacgaactcgccctttggatcgtaagtgtgcgcctgtttttcgaggttgaattgccgcgagccgcgtgggtcggctccgactcccgccaaatattgccagttgccccagttggatccgacatcgtaatccactaactgggtttcaaaataagcggcaccatagcgccaatctaaacctagttcgtgaactagacagctggcgactaactgtcgaccacggttggacatgtaacccgtttgattcagttgccgcatacaggcattcacaatggggaaaggcgtttctccgtgcttccactgtaaaaagcgctgcgcatagaaactggtgagcggttttttctcgccaatcccagagaagcgaaacagttttgcgccatagcgccgcgcgtaccagtaaaaatattcacgccacagtaactcaaagaaaatccagtaggtggaatcgttcgcgccatgtacagcttcataacgctgcaacatggcataaatggtttttggcgaaaccgcgccgagcgcgagccaaggcgaaaacttagtggaataatccatgccgtctaacccattgcgcgtctctttatagcgactggggagcagggaggagaaatagttttggcaatgcgtcagccctgcttgctcaccaccgacaaaggcgctgtgattcggctcggtaacaatatccatcaaaggcaactgccagccttgctcaatgggtggcaaaacatgcggatagcccatcggcgcagagagggagatcgtttctacttgcttacgaaattgggtaaaggtgctcggtagcgcctcaagtgcaaacggcaactgcggctcactcaataagctgtgcagagcttgctgatggatgtgcacagaagaaaagtcctgatgaatgcgcgcgatagcttggcgttcatctgagcccgccactgcatccacataaatatccgtaatctcgacttgagtcagtagatggcgcagcgcttgatagggcaaaagtggcgtcacccaaagcttttggcctagcgtactgagcgaatgatctaagtcagccaaggtttggttgagaaacctttttttggcttcgccccattgtgtttgctgggcgtagcgcgccaaaaatggcgtaatcgagggataacagtacaaacagatcaagcgatccacttgctgcgaggcttgctcaagtagcgggttatcgttcactcgtaaatcgttggtaaaccagtacaggccaatttttttactcaagttccactctcaataccgatgatggggttaatgagcgtttatacggtcaaagggattgagcgatcatgcggtaatgggattgatcctcgaaaagagagtgtgcgtaacagattgcaatgatgaatctgaggtcaatagccatgaataagccagatctggtgatcttttttgatggacaatgtccgctctgttgtaacgagatgcgcgcattaaaaacggcggatcaccaagcacgaattttgctggtggatgtgcatgatacggatacgatgtcctgctacccatcgatcgataaacaacgtgcattgtctatcttgcacggtatcgatcagcaaggacaacttttatatggcttagatgtgacagtgcttgcatggcgtttggtcaaccgacatcgctggcttttcattactcgtatgccgattttaaaggggatcagtgaccgaatgtatctcctatttgccaaacacagaatgcgcctctcgcgctggtttggccaaacccaatgccaagagggggtttgtcaaaagaaatagatttggtgactttacctcctaactacagccccctaatcgcttatatatgaattgatttttaaataacggtgtagaataagtgcggcgttgagccttgaatcaagaattactaagtaggaatcaatggaaaaaattgccattttggtggatgtacaaaacgtgtattacacctgccgcgagcaatatggccggcactttgattacaatcagttttggtcgcaagtgacgcaaaatcgcacggtagtgaaagccaatgcctatgcgattgccagtaaagatccgcagcagaggcaatttcatcatattttacgagggattggctttgaggtgatgctaaaaccttttatccagcgcagtgatggtagcgcgaaaggggattgggatgtcgggattgcccttgatggctatgaattagctcaggaggtagacaccgtggtgctcgtttctggggatggtgattttgaacctttggtgaccagaattgcgcaacgctttcaggttaaggtggaagtgtatggcgtgccgaaactgaccgcgcaacatttaatcgatgtcgccagtcaatttcacccgattgagcatcgtctattactgtaatgcgctattgctaagtgagggctcagtaggttttgcatcgctggttccaagctcgggattcgcttcttgttttgccgcgagtttagcccgctccgctttagaaatataacgaggcttgttgctcgggtgcaatttcgcatgttgctttttaaggcgtttttgtaatgtctgattaattttctttttacggttcatcgggttgtgctcgaaacaggatgattagggagtttccctgcgattgggcactgtcgctgtgttggtgcaatgctcagtcgtttgggtatagatagcaaaaaagacgccctaaggcgtctttttcttgaatgtggcgggagtgagaccgcacactttctcagttaacgctttgatttatattaatttaaaattttacatttgtagctagtattaccataggtattactttgtgcatgacttgacaatcatgcacaaaaatttttcccctttgacgattctcatgccgctattgcaatgctcttctcactctttctagagatacctgcattttcggtgtcagcttttctactctaccgtcatcgcaggattagcaacgattctagcgcaggagtttatcattgtttcagtagttaccctagagctctccttgctttaagtggttgcggtgttagctatgcttcatttgtaacaattacaccaattatctatcttgatgggagagtatgagtacaacctcttgctctaaccgtatatacaactccaagtggttgataggcaattgcacttaatcaaaaactattcagacatatgtcatcttcttgcaactaaccaacctgagaggtgtgaatatgccagagaacaacattcgtttgatccgctttcgagaagtgctaactatgactggtttgtcacgctctagtttgtaccgatttattgaagaaaaccaattcccgccccaagttcaactgggtggtcgtgctgtagcttgggtagaaggcgaggtgcaggagtggattgctcaacggatcaccaatcgtcgaatggattagtgaaatccattttaataatcgttaaaatattaaatgatgtttgattgaaaagttctcttattttctctcttagtaaaccagctctcgttaacgagagcnggtttacttgtgtgatcaattttttttaaatctagatatcgattcatacttattgtttatcagttcttctagaagatgattcttttttatctccaataggttagctaatctgtctagctttcttcctatgtcagtatgcatttcaaaggtatatacttttttattttttagtttcatcctatgttttttctgaacagatgctttctttagcttttctataaattgatgtttactcataaaattaggaatgatatcttttggatcccaaaggtctagaattgtaataatagagtaatgagctatatctcggtctaactcgtatggtaaaaaccatgggtcgagtttgcttttcttaaagtagttaattatccatttggtaaattcatcatccttattatcaatgatccaagtgtaatctatacctttctcaacattgcgccaggaatttttcagttggcctacaatgctttcctttatttctatgcaggtttttgatttgatgaatctaataattccattatatatttcatttttatcaactatctcctttgggttgataacatgagagctagttataaatgtttcttgcattgaatgtctgggataatgttcaaatgctaatattatatcttgtttaaaattaatttcataatctatcggtgggtcatacattggtttgaatgttgctgttaacttactttttaatctttcagaatcaatagtatgatcaacgatcacttcccttgctctcatatggacaaggtaaattttagacaataaatataaacattgtcgcgtgttgttactatcaatccaatctgttaaatatgaatatttaaataattcgttaatgtttgtcacaatgtgtatttacgttgttttaatgaaagttacatagtaatttttatgagttttacagtcttgctttttcctgtggatttgatgggttttgcggtgtgcatcacttatggtgcgctaatgtttttccagagtggcagaacgtgacattgtctctagatgtgcattggtacagaaggcgggtagctaaggtaattagttcgattatgttggtatagtaatataggtctagtaagcacattaaaataacaaggtggttatcttctatgaacaagttaacaatagaggtgactaatgaaacgtttaattcaaaatccaaacctgactcttttctatgacgagagttttttatctaatcctgtcattaaagaacatgctccattatgcaaggaatatttgattgccattaaggatgttttggatatttctttgactgaatatagtcgagtttacgttcagagaattgatcttagataccctagctattatacagggcataattgtggcgatatttctagtttttttcttcgttaaaagcaaaaataaaacatgacttaaaaataaagggtaaggttggtaaatgtactttaagatacgtttgggtaagggagcaattaagttcagggaatcctcattaccatgtggcattatttcttaataaagatgtttacttttgtttgggggatattactaaggatagtgataatttttcttcaatgataaaagcagcatgggcaagtgctttaggtattgaatactttgaggtgaaaagtagtgtgcatttcccaagtaactctacttattacatttataaggggaaagatccttatcaagaggaataccgacagtgtttttatcgcttaagctacttggctaaaattgatacaaaaatctattcgaatggattaaaaaatctctcgactagtcgaaaataaaaaagaggctcgcctctttttaatggttacatttaaaacccaaatgtatatcgtaaaccaccgaaaaatagaccagcgacagagcctacgactttacctaggatctcgcctggttttccgaaaatagatccgatatcggagccaatagatgcgccttgtaaagttgtttctacaatggcttcccaaaggcttaaggtggtttttttattgtaatcgctggcatcgttatctttccaattatctgcatcattggaaatggtacgatttgccagcattactcgtttattgtttggtagtatttcgacaatggtataaagcagttttgatagattgtaaggcctctggcgattgactccatcactgtagcccgccacaaagtaaagagtcttcacatttatctgtgtggctttatgtatacgtcttgctatcgagttttgttgtttctccagaaatgccttagccttgtccgttggtagattgtcgctgtagttccatgattcaggtcctttcaatgcaacgtcggcttgattcaccgcaacgatgagccgcttttcggcatcatcgcctaattgcgggataacaatgtcattgatgagtctcaatggtgttcccagatcgcgagagccgccatcaagtatcaccagaactaaatcaatggccaactgaccatggtcatctcgtttgttgagaagctgtttaatggcctgtacgtgttttttatcctcatcgatcccatctccaagccctggagtgtcccatagcacgagattatttaagtggtaacactgaacagattccgtgtgcggatcactatcgatgccgacttgggcaaccgtcatgtcaaatagggcgtttatggtggagcttttcccagagcctgtggaaccggtgatcagaatattcagtgatgctttgcgaaggagagataagttactgagtaacttatctttcgtggttgaatctaacgagttgcgaagaatgttattttctagagtcgagaataaatcagtggttttcattgttgtggaacctctttcaatgttgagatgatgaactgggaaatcgcgcccccccagaacacgatgattctctttatgaacctgtcggttttcttgatggaggtaactaaggagccgaggttaatgaaatatcatcaaaagcttccgttgcgacataggcgagaaagttactctcccataactgatagagctctcgcgcatcacggttacctacgataggattccatccgtgataggcggtgaagaaatccccacgctggaaatcaaaatccaagcagcgttctagctcaggaaagtggttgccgacataagcaaaatccgtgatgtattcaatacaccattggccatcactagactgactcagtgcaatttctaccggatgaaaaccgccatcttcggcactgtaagaactgtctcgaaagttcatgacaacctctttgctggtggcctgaacttcactttttgcttgatgttcagaaagtatgttagcgagtagggcatgaaacggtttggaaatgggaaggtgggtgggtttgaacaaaatgttagacatggttatgcctcctacaaaaataagattcgattaagaagaatcgccttgggttagcgaatcatggtgagttgaatatcttgcaacgcttgtttggcaaggtggtgctcaaacgctgcgcaccaactgcaaaataggtccaacacttcaggttgggccaaatcagccgtaccggcatcaggctggtaacaccaacggttagcaaggtgaaagtagagctcgacatccaacgagtcatgcctgtcattctgataagaaaaactggcgataaacgcgatgaaccacagggactcgttgttttctcgcttgaactgtatttcgaccggatgtaggccctgtcgagagcggtaatagttgtatagaaccaagataataatggattggcttcaagataattcagacaaagattagggatcaggctggattttggcggatcgatcccgcttagattgggataggtgtctcacacataaaagagaccacattgtgagacagaagtaactcacaatgtagtatcgagcagaacttaattaaacatgataatgttcacacatggaacactatgatgttcatttgtgattctctatagggtgtctacattctaaaccctaattgcctttttattctggtttgcatgttgataaaacccagaacttcatattttacggctcgctttagagcttctacattgtcccatggttccgcttctactcccttgtgatgaagaacacggttgtagattgtggcaatatcaccgcaatatggctttgtgccagattctgcttcaaattccatttctatatattccattaagttaacacatacctcttttcggtcctctgttgtcggccagctattttcttctccagtcaaaagccaattcaaatcgacccttagtgtcttatgaagcgtaaccaacgcttcacttccaggagattgtttacctgacacatagctttgcagtgaacgatatggaatcccagtaaactctgatgcaccttttaatgttgagaacttggcatctataacgctctttaagcgctctgatatagacataaaaacctcaataaactacttgcaatgaacattataatgtatatattagtcattatgatgtctaagtgatatagcggagtaataagttaatgcttgaatatgtttcagtcaatcaaattgacccaggaaaagagctttacaacaaagtaaaagctggattcatcatcaaagggacaacattgggcgcttggtgtagacaatcaggcgtaaagcaacaaaacgttatgtcctgtcttatcgggtcttgggatggtccaaaagcaaaattgctaagagctaaagtcattcatgaatcaggaattgttggagatgaatatggaaagtaagaaagaaaaagatgcatttctgaaaatttccagaatcctgtccacattaaatgtgtatcaggcgaattctgtattaaataatataaatcaacaagttaggatttcatcaattgaatcgaacgccacaaagacaagtcgtaaaaacaaattagaacgtgaccgtgaactgtacgagttcattttaagcctagatttggatttcctgacccaaaaagacatcaggatactttgtatagaaaagttcggtgcggaaagaagcccatcaagaactggcttaagtcgggcactaaaaaaaattcaaaatcagaaaacgtatttgaggtaaagcaatgacaaacgtacgggacacatcaaatacatgccaaatgaaatcaacgaccatcgccttggtcattttagaaacattatttgaatacggcattaagggcgcaacttttcgagatatcggatttaaaacacagatcccaagagcaacactgcatcggtacttaacagcactagttgatgctggttgggtggaggcatgtggaagtaaacagaatatggtttggaaaccatcaaatcattttatcaagttagctttcacttatcgtaacgccgttcgcgcagaagttgatcgcattggagctgaatttagagagttaacaggagaggatttataagatgtccgatgaactgaagcaattaatgaccgctcaacaagcattgagcgatgcgcaagaactgaatgccgctgaagcattaacgatttctcaaagtgagggaacaaaacttggtgaagccgtagacttgggtgctcttttggggcgtgctcagatggccgaaagactgtcaaaaattaccgacgccgtgagtttgagtacattgaaagaaatcaaagagtctaagaaatacaaggctttaaaaggaatcaccttttcaaaaagctcgactgtcggcagtaatttagttgttctaaaaggcacttgggaagagttttgtgaaatctatggcagttcaaaatcaaccgttgatgaacgactaaaaaatttagacgtatttggtgctcaggctctagagtcaatgagcgcaataggtatgactaccagagacttacgccgacttcgccaactgcctcaagaagatttgaccgctattgttgagggtgaagtggttaaagttcaagaccgcgatgaagccttggaaatcattgaagagctgtcggcaaaacatcgccaagaaaaacaagctctgcaatccgaagtcactaagttgacacaagaaaaacaatctaacgaaaggctgctagcggataaagataagaagattaatgacttatctaagaaactcgatacgccgctttcaccagcacaagcgcgccagaaagaagaagaactcaacagcaagttactcgatcaattgaacgtggcaactctggccgtcgatagtggtttggctcgtctgtttgatgcgattcaaacgattcatgacaacccacatccgaccgatattgatgctgcttgtgaaaatgcgttgttccataccctagagcgactcctcgctttatcagcagacttagggattagtgcgcacgtgcttagtcatttagagcaatggcatgcagaaaatggcctgttcttgggtaacgagggctgatccacgatgaatgcacttgaattagaacgcgcacaatatcttaaacgtctgatgtcggatcttgaccgctctgggcgtggccaaaaaggggttattgttcaagctgcaatggatcacttgtgtatttcaaaaagcaagctgtatcaagagctaacggatttaggctggacatctgggcgaaaaacacgagcggataacggagacttggctctcacgaaagaagagaccgagctgctttcgaacatgatccgccagagtaagcgagagagcggcaaggcactgatgacggttcgtgatgcggttgatattgcattagccaatggggaactcacgagacacgtgtctgaatcgacagtattacgagcttttaaacgctttcgtgttcatcctgaccagctcgatatgatggagacaaccatgagtcagcgctcgctttttcccaatcatgcttggcagtttgacgtgtcgatttgtgtactctactacctgcgtggcggtaagggattgcaagtgatgtctaaggatgagttttacaaaaacaagccaaagaacttagaccgtatcgtcaatgagcgagtattgcgctatttagctacagaccattacagcggcgctttctttttacgctactaccttgctccaggtgaaaacacagaaaccattactcagttcctattggaagcgttctgcgagcgtgatactggtgaattgatgtacggcgttcctcagatcttaatttgggacgcagggtctgcaaacatcgcccaccaaacgcgacacatgttggacatgctggaagtgaaacatatcgctcacacaccaggtcgtccttgggcgaaaggtcaagtggaatcgacgcataacctcgtagagcgccgttttgaggggcgactcgcctttatgacagtgcagtctattgaggagctgaatcgacacgcggtgcaatggtctattggttttcagtctcttaaagagcacagccgacataagaatagccgctttgggctgtggcaaacgatacgggctgagcagttgcggctgatcaaagacgtgaatctggtgaaaagcatgatgcaacaaactaagccagaagttcgcaaagtgcgtcctaacgaactaagcatcagctttgcaccaaaaggctatgcatcaatggattactcgctggctcacattccacaccttattgctggtgatgaagtgaaagtgtttgcaaatccatacaaagcgccagctattcgtgtgataagtgtggacgactcaggacaagagcacactcatgaagctacgccaatcgagcgcgatgctgcgggattcaacttgcttgcgcccatcattggtgctgaacacaaatcggtacgtgaaacagatgctgatcacaaccgcaagcgattagacatacaagcttggggaacggacaacccacgcgatattaagaagctccgcaaaggaaaagtagcagcattcgatggccgaattaatcctatggcagacattgagcagcaagttgttccctcatttatgccaagacgtggcaccgtaatgagtatggagggacagccgttaaccgagcaaaaaatgtcgtttattggggctttaaaccgtcttcaaagacgtttgaacccaaccaaagaggaacttgctgtcatgagaaaggtgctcaaacagcaatacccagatggcatgaccgacaatgaactacaagtctttaccgaacaatgggagcaaaaaggcaatgaacacgctcagagcgcgactagataaggcaggcacaagcatacaagcattggctgactatttagcgatgaactacagcacagtgcagagagcggtgaaaatgaacgaaccgcctaagagacgtgcagaagaatttaaagaaaaagtcgaagcgttttttgcttcgcacggcctggaaggagtaagcggttggtcaaaggcggcaaccaatgaccaacctgatccccagactgaaacaaatcgagagttagaactggagaatcctatgttaacacaagaagctatgaagcactttaagctatttcgcaacccttttattaatgacattcgcgctgttcgcgacatctatatgaatgaagatagtcgatatgttttagctgcgatgaaagatgttgcaaggaatcaaggtattttggctgttgtgggagattctggcgcaggtaaaagcgtgctgcgtcgattgctactagatgagctacataacgatggcgatatttcagtgatccaacccaaaatcatcgacaagacgcgcgccaccgcagcaggtatttgtgatgcaatcatcagcgatatcagtagtgaagcacctaagcgcagtatggaagctaaagcaagacaagtggaacgtctacttatgacagcattcaaaggaggacagcgccacgttctgatcattgaagaggctcatgatttgacgattcctgtcatgaagtaccttaagcgcttttgggaacttgaagatggtttttcaaagctgctgggtattttattggttggacagacagagttgtttcaccgcctcgatgagcgtcgtcattacgaacttcgtgagtttattcgacgttgtatggttatagaggttccaccacttgataacgatattgaagcttacctcaagcataagtttgaacgtgcaggatgtgagtatgagcgcatcatggatgatagtgcggttcctgccttgaaactgcgtttacaaactcgccgcaaccagtcaggaagcttggtttatcctcaggtcatcaataacctggtaaccaaagctatgaatctttgtgcttctttaggcgaagacaaagtaaatgaagacatcattaaggagctgtagccatgaacaatcagaatgataatggccttttgccctttaacgttggagagttagtcagtgcagttcatttcgattgcaatgattttgatacggctgactacatccccagtgtccagctccgccaagacttacacgataaactcggttgtgcggtaagtaacttgaatagcattttgtctatttacaatcagtggaaacaaggccagttatcttgtaattggtctgctgtcagtgagttgacactcagaacgcaagttgtcagtggacaattcaaaacgatttcacagatgtgccgaaatgatcgaaatgggatggtttataatcctttgttaaatgatggcataccagatctatcaaaaggattaacacccttagagtgttcggagttgaaagcattgttggatggattacacccaattgagctgttacagttactaagacatcaaaaaggaagtttggtatgaataatcatcacttgagtgctgctgaaagccatgagctagcaacacgagtatcagcgttaggtgcaaaacaggttttgcttattctccgccaaattcaggatcagtcgttggattcgtccatgaaaaacagaggccttatctatgaacgagcattacgaacaaaaactgaagcaggctctacggcaaaaatcggtcatgccttacttgaccatcatactcggccccactaaagagcaatgtcctgtgcatacaaagaacaaaggcctagtgttacctgttgatgaccgctactggacagagtttccaatgcgagagacttcggcttgtcggtgtagtatccgacaggtatcgaaatatgaataccagaagttaaaagccgaaggtgttctggaagtgccagtagattaaaccgccttcaaacaagccaatctttaaatgccttttcattagaagaggcatttctttctgaaacgccctcaaatcagtttctagccgtgatgcgagtattcgcttgtctaaaaaagtttaaatcaatctggtgcgatttaaacagggtttaaacatggtttctgcacatatcagtgcttatatataactcccacaatgcccagtcccctttattaacagcaactcctgttaatttagttattactgcaacggggattattcttgtattgctgttggggcatatggagataagtcggttctccattaaatggcaatacatttgccatcaacttagcgtagccctatctgcaaatttgggtagggttacgctaggttcttcgatgtctatatagaggataacgatgttagctatagaaagagcaatcccattggttgttgacgctttgagcaaggattcggggctttttagctttgatgatcttgaaagcggtgatgctttatatccagagctgctaagtgatgttcatgacatttttcttggtgtcattgaagacgcaggtattgaagataacgggttggcattacatctggtttttaaattgatggaatacggcaatggtgtgcagttttacctaccgaagcctgactctattgtaaaaaccattatcaagaaaatgatgaaaaatgacttcaacggcagcaactacgttgaattagctaagcgttatcagtgttcaacgaatcatgtaaggagagttatcaatggcacccactgataatcaaaggtcgcttgtgatttcaaaactcactcctagcgctcaagtgctctaccgtgcattagatgaagccattaagcaaagtgctggtaaacctgatgctctaaagattgttatcgagcttagtgaaaaactaggtggaagaactttttacttttctcttggcactgtggcacgaagaactcaaagaaatattgatctcttcgcagaccacgaatcaggcatgtcagtaagagaactctcaaaaaaatataagttaagttttgtctccgtttttaatgtcattcgcaaattcaaaacgtcataactagataggaaattaaccatgtcattaagtaccttacaagcagaattggcttcagcaaaaacagagtatgaagctaaagagctagagatcagaaacctattttctgaaaaaaacactcaagaacgccgcctacaaacactagttgctcaagtcgcggctaagcgtaaagagttatcgaatgctttatcgcaatcttctgctgaaactctaaccagtgagctgcaatcattggaatctcagtatcaagcatgtcaaaccttgatcaataacatctccaattatctaacagttaaggctggattggataaaaagaatgcctctgaacttgtggaacgtgcgcaaaaaaatttactcaatttcatctacaacagcatcaaatcagaactcaaagtcttaactgatgagcaagtagagttgatgaaagattttgttgtgatcgaaaaactgattcgtagtgaattgtcagatagcgtacgccaaagttatttcctaggatgcgttttcgatgaattatacggtcaattaaaaggctctgactttactagccataaagaaaagatgctgaaaaagtacgatgcagaatcgtccattggatagtcgtcagtcgatttattatctcagtggctcactgccactgagactgcgaaaggaatgaaaatggaacatgtgtatcaattagtcgatggcattgtttttaagggtaaattacagaaacaagtcacgcttcacccaattgatagtgtgtcctacgacttagttgaacaactagtcgaagaacaactgcaacatatacaaaatcaagcagatgttgtcttggttaatgatagtcacctccaagggcttaaaggctatatgcttttaaacgagagcgcggcaagttcaatatcaaaaatcggtgatgagaatgtcgatttgatgttcttcgacttatgtcagctaaaaatcagtgctcaagactggaatgtgatcctcactgcaaaccttgcaatagcagaatactatgcaaatcaggcagcgatgcttgcctaacgagagtattggcctgaatgacctctaatttaaataggaacatgtgaaatggctgtaatgacatttaacttagaagatggtttcaaggttggggatgcccaatgccatgaggttggactcaaagagctaacacctaaggatgtttttgatgctcagcttgcctcagaaaaaattggaatattgaatggtagaccccatgcctacacttctgatgttcaaatgggtatggagcttttatgtcgtcaagtggagtttattggtaacgtacaaggtccatttagcgtcaaagagattttgaaattgtcttcacgcgactttgccacactacaacaaaaagctcgtgagcttgatgacattatgttttcagatgatgccttggaggggcttgaggctcgggggcgagattaaatcacttgcagctcatttagagctaatgttgataaacgtaggctcacgctatcctgtaagtgatttcaatcatcaaccaattcgtagacttatccaactcatttttcgattaaaagagcagcagtgagatccccatggctaacaatttaaaaacggatattgttttaaacctccagggtgatcttgcccagaaagcgcggtcgtatagcaaagaaatgacaacgctagcaacacgttcaaaagctgcatttagcatgattagttcatcagcaatagcggctagcagaggcattgacactttcggtaatcgactgctttttattactggtgctgctgcggttggttttgaacgtacattcgtaaaaactgctgctgaatttgaacgttaccaaacgatgctaaataagcttcaaggctcaccagaagctggagctaaggcgatggcatggattgaagagttcacacaaaacaccccttacgctatcgatgaagtaacacagtcatttgtacgtctaaaagcctttggtattgatcctatggatgggactatgcaaagtatcgccgatcaagcggcaatgattggcggtacagcagaaacagttgaaggtatcgctacagcgttaggtcaagcgtggactaaaggaaaacttcaatcagaagaggctctccaactactagagcgaggtgttcctgtttgggattacctaattaaatccagcaaagaactgggaatgaacaatggccgtggatttaccaaagaagagctggatgatatgtcatctaagggaaagctaggtagggatgcaatcagggctttaattaagcaaatgggtaaagaatccgctggtgcagccaaagagcagatgaatacatggaatggtatgatctctaacatgggcgatcactggaagctttttcaaaaagatgtgatgggaagcggagcattcacagttctaaaagaccaattgggtgagttcttggggatgcttgatgaaatgaaaaagactggcgaatacgacgagtttgtcgataaagtcgggcgtgatcttgttgaggcctttaaatcagccgctgctgctgcaagagaaattaaagaggtcggtgaggaactatggcctgtgattcgagagattggctcaatggcttgtagtggcatagtgaatttggtcacttagttagaggtgatatcatcacctcataagttaacaggtgacattatgacaaaacgtacaagacgactatttagcgcagaatttaagttagaagcagcgcagctagtcttagaccaaaattactcagtgacggaagcagcccaagccatgaatgtgggcaagtccacgatggataaatgggttcgccagcttagagaagaacgccaagggaaaacacctaaagcttcacctatgacccctgagcaaatagaaattcgggaattgaaaaagaagctggctcgccttgaagagcataatgaaatactaaaaaaagccacggctctcttgatgtcggactcactgaacaattcttgataatcaagaaactcaagcagagccacagcgtaaaaatattatgcgaagtcttcaatgttcatcgaagtagttatcactattggcttaaacgcccagcgttaattaatgcggaaacaataaaactgcgcagcttgattagcgaggctcacgccgcaagcaatggctctgcgggagcgagaaccattgcagatatagtcacaaatcagggtgtaaagctgagccgataccgagcaacaaagctaatgagaactcttggtttagtaagctgccaagaaccaaagcatcgttacagaaaggcttcacaagaacatattgacgttccaaatcacttaagtcgtcaatttgctgttacggctccaaatgaagtctgggctggcgatgttacgtatatttggactggtaatcggtggatgtatttagcggtcgttatcgatctttttgcccgcaaagtgatcggttggtcaatgtctttgtcgcctgatagtcggttgacaggtaaagcgctgtctatggcctatgaatctcgcggaaagccaaaaggtgtcatgttccatagcgatcaaggcagtcattatactagccgtaaataccgtcaattactgtggcgctttcaaataaaacagagtttatctcgccgaggaaactgttgggataatgcgccgatagagcgcttctttagaagtctgaagacggaatgggtgccaactgtgggttatcgtagcttcgctgaggctcaacaagagatcacccgctacattatcggatattactgccaactcaggccacatcagtataacggtggtctaactcccaatgaatcagaacgattatattgggaaaactctaaaaccgtggccaattttagttgaccactacagctaatagtttggcagagactgtgggaggttacggaaatctagcaaaaattctggcttcaatttacgccattaacaaaatgctgcgaataggctcaccccttctcaaaggtggagccatgattggagatatggttcttggcggaaagaaaggggctgcgggagctggttcgttgagtgctttaggcgcaactccagtctatgtcgtgaatatgcctaatggcggtcttggtggtcctgacgtaaactttccagataacaaaaagcccaataaatcactctttaatgcaagtaatttagcaaatattccattgattggatgggcttcttacgaactagcagatctaactgatagtgtgttgtcatccaattttgacggctatagagaggctgatgcaaagttcactacgaagatgaaagcattttttggtgataaggaggctcaagctcaagatgttcaatattatggagctgaccctgcaaagtatgaagtcaagccaatgtctccccccgaatacatgacaggcgggtataataggagtccgatatcaactcctagttcttatcttgcagctcaagcaggagagatgaaattaaaagtagaggtttcggacgatagggtaaaagtgacgcctacttaccttccaaaaggattttctgtagatccagatactggtatcaactaggtgaaaactatcgataaaatgaaatcgccatctcatactatgggattctctgaattttatttatcttgaaattttaagcgttttatcttggcgcgctacaaatagtttggatctcgacagttgaggactattcgctctgcctcttgtgggatgtcaaaacggcgaagtatcgcgctcaacgcatgacaaaagctgtcagctaactggatcgtttgatagctttccacaatcatagccagcccctttctgcaaatgacacactgcttttgccaacgaccacatggtctagcacacgaatatctaccagtgataaggcgtcttttaagcgctgagtaatacgcctatcggcttgtgaaggctcaggatcgccagaggggtggttatgggcaaagatcaccgctgctgcgttaacgtttagtgcctcctttaatacctctcttgggtagacactggcggcatcgaccgtaccgcgaaatagctccttaaattcaattagccgatgctggttatccaaaaacagtacggcaaagatttcgtgctcatatccagcaagtttacagcgtaagtattccgtggtgttttccgtacgtgcaaaggtttcaccgcgcacataacgctgttcaaggatctctgctgcttcttccagtactcgatgctcataagctcgttgcgagagtagatagcggtggcgagggaaatgagtcatagcctgctccttaacaatagtgggaaggttcacagtgatgacatatatctaaattggctttgaatataggtaagggactgatttaactattttttacagagtcagttcatcccatgggacaacaagacataggagaacatcccatgagatttctgaaactaaaagaagtaatggaaaagaccgcactaagccgttcagcaatttaccgaaaaatgaatgatggcgagtttccacagtcggtgagcttgggagaaagggctattgcctgggtggaaagcgaagtggatgagtggatggacttttgtcttaaacagcgatgatggcgtgattatacatgcgtcatgtactatagctgagagtgtaaggtgcctgatttgtcaatttgagtactggtttgaaacggtgacgagaaataagctgatagcatcatttgatgtgctatcagctttaacacgttaagctgctcttagttttgcgataaggtcagcttctgttttagcaatgtgataggcatacgaagaattcgcatatttgaattatccgtttcaacaatgacaatcgcattttccgaatccaattgataaatatcagaatatgccgatgcaccattaacaagttgaattggtcctttccatgtcaccccttcatcgaagctaaaccataagcctagattttgcctgccatttgtccccgcagggtttccttgtgggttagtaaagagtaagaaatggctaccgtcactttgctcgaaccgagtaatagaagcatcaacggtaccagtactgatattgctaaagacgttagcgttgttagcctcaagtaggctccacgtgattccaccatctttactcaaaaattgctggcgtgggctatagttcacaccattaacgatttggttaaaatcaaggcgtgcagtaaggagtagatcaccgttttggagttcaaccatatcagcttcactaggttcgagagtttctaggatactcgaactcttccagcgaaaggggatagggagtgttgaaccggtttgccagtttgaaccgccatcatcactgtaaatagacatgacgttcaagaagaaacgatcaagcacaatcgctgggtagatcaagcggccgttttggctgccactgatattttgttgtcgagtaagggtgatgccatgacccggtcctgggttgacactggcatttccatacaaactcatggtgttgcccgttttaatttttgtccaaccaagcttttcaaggtctttctctacttcaggggtttgctgtgctaaatagaaagcatcaaactccacgaggttatggccttgctgtgtgagaacaattttttgcacatgcagtctgccgtcaatttgggcatccgcattaccaaactgaatgttgttctcctgcgatacttcgccagcccaagttgtgatttgctgaccatccacgaataacgttgtggtgtggtttaacgccgaatattgaagttcgtagtcatggaaagagtgtacctttgcgtgttcagattgcaggataatcggagcactaacaccgtttagattagcgactagaccacctgattcatcaatactcagtgtgacaacatattttcggctaccatcggcaacttgtatctggttcgctgcaccatcaacaattcggatcttagcgtttgattgccagtcttgctggctatttaggctggtatttcggcgatacagctctgaaccaccccaaccagcgatttggaaactgcgttctttcacctgatcggtaacatcgataggcgcttgccagttccctgatgcaacatcatagacgctgtaaaaaataccgtttggcatccatggttttattcgatctccgttttgagcggcatcggtcggccatcgagcataagagacaagaaccgtattggaggaaggatcatagataggccgaggatcggagaaatcaaactcatcactgacattgatttgctcagtgaggttgagctcggtatcccaagttataccgccatctcgtgaggtacgagtgattatgtcattggtattactcagagcaccgggatctcctccccccacacgtttctctgcaaatgcggttaccacccctggtgttacgctacttgctacaatggacggtatacggtctgggcctctgaagatgacgtcgccttgaatttcaaacttaatatcacgataagcggcgacaccatccgtatttgatgagccattcccccatacgatcatattttgttttgatgcagtcggctggatgttgtcacgaatgagtttgccatcgaagtaaaagctagcggatgggttacttccaggaaggaataccaattcaaatttatgatattccgttgctgctgtgccggttgccaaaacggtgcgtccagtttgcccttcaaactcaacaactaagttaccactgctatctaatgaaatgatgggtaagacacgctgagtgccgttggcgtagtagtttgtgatcattccaccactgagcactttcatttctgtcgtcattcgccaaccgaaacttgatgcttgggcatgttgattagtagagagagaatatgtccattgagctctccctccaataccttgcaccaaccaagcgggcattccatctgcattggttaaaacgccgctgccattattcgtgttgtcttgcatccatccctgtttggctggactgtcaaactcagtgtcacccgttgcgttatagtcaaaaagtgcggcgtttgagcttgtcgccataccgaacattgcaagcattaaagcggttttctttacgtttttgaaacgcatatctactccctttatattagaatctgtttccttgtgaatcgatgctcttcttcgttgtgaagtcatcttgattgacaagtctccatcgaatgtaaggcttggaaacgttcacatttccagttgtagattctcattaaaaaatattttcttcatgaactgcgatcgcaaaaaaaaataatttccataaatgtttttgtgtgttgtttaatcgatgagacatcaacacgttgcagttatgttcgtacttagatgtgtgtagttgggttagaggaggctactgaagtaggaatagaagcgacggaagtacagttaatgcctaaaggcatatagattttttgggaagagctattccaatgatctctgctgaacattggaatagtgaacgatctggtcaataacggataggcatgtttgatcgatagctcagttgtagagcacgccttcactgactacagccaagctttcatatttggagtttaatacagtggcggcggctcgataattgggttttagttgccctaaatcatcacattgaattgcttgagccggataagacgaggccatttttaatgcttcatcttccgcgattccccaacgaataacattggcaaccgattcatccatcccgatgtgtgctcccgcaagattgcctctgctattaatcagtttattatcgatgacgcgaatggtttccccatccaattcaaactggctagtcacactgccaaggctagccatggcatcggtaacaataagaagtttgtctttaggtttgattcgcttagcgagtaaaaaactttgtggatggacatgaattccatcagttattactgaacaccaagcatgatcggtattcaatgctgtaccgacaactccgggttcacgactctcaaaaggcgacatggcattaaataagtgggtaaatccatcaatgagagctaacttctcagtggttaattgggctgtagtggcattactgtgaccacacgagagagtaacatgatgatcctttaaccactttagtgagtcgatggagaggttttcagccgcgaccgttacaagaactttgcctttggttggccagtgaaactgtgaaagttgttcgggtgtcggggaatagaacagatctgggttatgagcgcctttcttttctgggtttaaccaaggcccctctaagtgaatacccaacacacccgagacttgattttcgattgcagattgaatggcatcaagtgcacggttgatgtgttccggtgttgcactgattaaggttggaagcagataggcggtgccgtgagttctgtgtgctcggcagatcgaatcaatacccgcaagagtcatgtcattattgaacatgacatcgccaccgccattaacttgtaagtcaatgaatcctggagcgatcaatgcaccatcaaaatgttgatgctcaatatcctccgtcagagactcaataggaacaatggagtgaatgtgtgaaccttcccaaaccattgccgcattctcgtaatactgaattccatcaaaaagccgtgtggctgaaattgcctttaatgccatcgtttactccttaaactgaaatgctgctccgagtaggcaagcatcataatcgccatgagcaggagtgacagggatgtgaaatacggatggcctagattgaatagctttgttgaggcgttcaaggtagccctctgcgagaccaattccaccacccaaaacaataatatccagatctaagcatgctttaagattacagcataatgtggctactgcttgcacactgcgattgatgatcgcttctgctttcgggttgaacgctgcttgcttaaataactcaacattgctcattgtctcggtaaaagtggcttcgctctctttttgaatcgcgttacctgaagccatggactcaacacaacctcgctgaccacatccgcataatggaccttcaatggccaccgacatgtgacctatgtgtcccgctaaaccgctgtttcctttgtgaagcttgccatcaatgatgattccgccaccaacccctgttgaaaccgtaataaaagccatatttaagctaggattttttaactgcacaaattcaaaccatgccgcggcctgtgcatcattaagaatggagactggtttattagtgagttgttctagcgtttgagctaatggaaaaggtacagggaaattaagagtctctggatttatcgatgtgatgccttctggcgttacataacctgttgttgatacgcctacataatcgatagaagggagccattcagtgaccttttcgagaatcgcttgaacaaacttggtgacgtcctgcaccacaggcgttgctatctggtaacgctgtatgatcgtaccttcttctacaatcgctaatgctatttttgttccgccgatatcgatggctagtgtgcgcatttcctttctcccgcagcttgggttgcgttattgaaccattgagtaaccacttctaatcgagtcaatgcagaaccaaccgttacggcaaccgcaccagactcaatagctttcgctgctaactcaggcgtattgtatcgaccttccgccatggtaaaaaagccggcttcagaaaacgctttcacaagttggaaatctggaaccgtgggctcaatatctccgacatagcctgacagtgttgatccaacaatttcaacaccttgtgagttagcccataatccatcctcgaatgtggagcaatcggccatcgcaaaacatcccgtgtttttgattgcttgcgcaatacgttctcgactttcagggcgtgttctatcggtggcatcaaaagcaatgaccgttgcgccagcatttgctaagccatcaacatctgaaacaaaaggagtgattcgaattgggctatcaggcaagtcacgcttaacgatacctataatcggaattgttactgcggcggatacagcagccacgttattcacaccttcaatgcgcagcgcttttgcacccgcttgttcgacggcgatcgccatcgccacaatgaaatctgttttatcgagtgggctgcctgttacaggttgtatggaaacgacagtttggccgtttaaaaatcgctttaactcttcgatattcaaaaaattctttctcacgacgggcctcatttttcttttctaaaaacgtttttaattcctgacttgatgaacaaaaggactcttgtaaccaaattttgttcgccatcacactttgaaaaaaggtggtttgaaaataatctccaccgcaatgataattcataacgaagatttttttcaaacgaaataaaagttttttttgaaaatggtgagacaaggcgtaacaggaaagaacaaagggaaaaatatgaaaaccattaataagattactatcgcaatacttactttgagtgctgctgcttctgtcaatgctgcgacgactttaaagatggggatgcaagcttctgtggggtctgtagagtataactcggcaaaaatgcttgccgacacattagaagaaatgagtcaaggagagatcaaactcgctttgtacccaagcgcccagcttggtgatgatcgtgccatgcttcagcaattgacgctgggagatctcgatataacttatgctgagtttggtcgtatggggctttggataccgcgagcagaagcggtcatgctcccttatgtcgcgaaagattttgaccatttacgccgcatgtttgaatctgactttggtcaaggtgttcgtgatgaaatgctccagaagttcaactggcgtgctttggacacttggtataacggtacccgtgaaaccacttcaaaccgtcccctcaattcgattgaagattttaaagggttaaaacttcgagtcccgaatgctaagcaaaacctcaactatgcaaagctgtctggtgcctcgccaaccccgatgtcattctctgaagtttatttagcgctgcagaccaatgccgtagatgggcaagaaaacccgctaccaacaattaaaacaatgaagttctatgaagtgcaaaagaacttagccatgacacatcatattgttaacgatcaaatggtgatcatttcggaatctacttggcagaagctttctgatacggataaagacatcattcagaaagccgtgcagaaagtgggagatgctcatacacagaccgttaaaactcaagaggcagaattggtctccttcttcaagagtgaaggtatcaacgtgacttacccagatctggagccattccgagaagcgatgcaaccactttacaaggagtttgacagtaacatcggtcagccgattgtgtcgaaattggcagcaatgtaaagggtagggttctctgtctcattaaattagctggccaggactggtcagctatggagcttaagatgttacgtaagataattaataatattgaagaaatcattactgtgcctctaatggcggccttgcttgctgttttgacttggcaaattggtacccgttggcttctcaatgatccttctttgtggagtgaagagcttgcccgattactcttcatgtatatgtgtttagtgggatgtgctatcgccattaaacgaagttctcacgtcaatatcacttttttctctgacaaacttcctgaaaaggcgcgcttgtctttagtcctatcgttagagattgccgtgctggtttctattggtgcaatcattgtgctcggctatcaacatgcccagcgtaatgcattctttgaattgatcacattagggatatcgagtagctggatgaattatagcttacctgtgggtggcgtgtttatggtgtttagacaactcgaaaaaatctttaaccttatgaagctgctactgggtgttagctcatctgcttcattaattgatcagcaagtaacggagaggtagtaggactatggttggttcaatttttggttggttaggattgttatttgcgggcatgccagtaggtttttcacttatttttgttgcattagctttcctcattctcaccaatagtacagggattaattttgcggctcagcaaatgctgggtgggatcgacaacttcacgttgctagccgttccattttttgtgttaactggccatctaatgaatagtgccggtattacagaaagaatcttcaacttcgcgaagtctctcgttggccatattacgggcagcttgggtcatgtaaatatcatggcaagcttgttgttctctggaatgtctggctcagcattggcagatgcaggtgggttaggtcagcttgaaatcaaatccatgcgtgatgcgaagtatcacgatgatttcgcgggcgggctgacagcggcatcttgcatcattggtcctctggtgccgccatcagtaccactagtcatatacggtgtggtttccaatacctctattggcgcattatttttagcgggtgcgatacctggtttgctgtgttgtattgccttgatggtgatgagttattttatctgcaaaaagcgcggatatatgacattgcctaaagcgagcagacgtgagcaatttaaatcacttaaagaagcatttttatcgttgctgacaccagtcattatcattggtgggatcttctctggtaaatttacgccaactgaagcggctgctgtttcatctctctacgcactatttttaggtacagttgtttataacacgctcacgttacaggggttcatcgaaattctgaaagaaacggtcaataccacagccgtggttgctctgatggttatgggcgtgactgtttttgggtggattgtggctcgcgaacagttaccacagatgttggctgattatttcttaacaatcagtgataacccactcgtactgcttctgttgatcaacttgttgctcctcttcttgggcacgtttattgagtcattggccttgctgttgctgctagttccattcttggtgccagtggcttcagcggtgggtatcgatcctgttcacttcggtgttatggcgattcttaacctaatgattggcattcttaccccaccaatgggaatggctttatatgtggtttctcgagtcggagatatcccattccatacgcttacgcgtggtgttttaccactactggtgccgctattcatcgtgttggcgctggtggcggtattccctcaatttactctgctactaccggaattattcctcggatacggacagtagttgaactagcgaactatagaatttaaaggtaaacaaaatgaaaaaattaacaggtttgattgctgctccacatacgcctttcacaaaagataacaaggttaattttgcggcgattgaccaaattgctgagcttctgattgaacaaggagtgaaaggtgcttatgtctgcggaacgacaggtgaggggatccattgctctgtcgaagaaagaaaagcaattgcagaacgttgggtgaaagccgttgatgggaagttagatgttattttacatacaggcgctttaagtattgttgataccatcaacttgacagagcacgctgaaacactggatatctttgctacctccgctattggcccatgctttttcaaaccgggaagtgttgatgatttagttgagtattgtgctcaagttgctgccgcagctccttcaaaaggtttttattactaccactcaggaatgtcgggcgtgaatctagatttagagcagttcttgattaaaggcgaacagcgcattcctaatctttatggcgcaaaattcaataatgctgatttgtatgaataccagcgttgcgtgcgagtatcgaatcgcaaatttgatattccatttggtgtggatgagtttttacctgctggtttagccgtcggtgcggtaggcgcagttggtagcacttataactatgctgctccattgtatttgaaaatcattgaagcatttaaccatggtaaacatgatgaagtcgcagcgttgatggataaagtgattgcgattattcgagtattggtcgaatacggcggtgttgcggcaggtaaagttgccatgcagttacatggtattgatgctggggatccccgcttacctattcgttcattgaatgacaaacagaaagcggatgtgcttgcgaagatgcgtgatgctgggttcctgtcgatctaaataaaggctagggaggaatattcatcctccctaaaagaagatttaagaacaaattatcatgatgatgtattaatagatctaggtctttggtacttttatggtagtcaaaagaatattaaggactccaagtgaatttgcctaaaaatctgatggttcgattgcgctcgaataccgaacctttgagcaaaaaactcagagttgttgctgattatgtgctcgaaaatgcacatgaagttcagtatcagacgatcaccgatctagcgtttaatacaaaaacaagcgaagccactgtagtcaggctatgccgtgatttgggctacaaaggttattcggattttagaatggcattggcggttgatcttagtcagtctgcaaaccaatctcagcccaaaatggatggcgatatttgcgaagtttctgcgcaaagcgcggtagatagtttaatggatactgcaaaactgatagacagagctgccttaaatagaatatgtgagttggttcatggggctaagtttattgggtgtgttggtgtgggagcatccagtatcgtcggtcgctatttggcgtaccgattagtgagaataggtaaaaaagccatcatgtatgaagatacacacttggcggcaatgagtgctggacagagtgttgtcggggatgcatggtttgcaatatcgagctcaggttctacaaaagaggtggttcatgcggccacccaggctcatcaacgcggtgtgccagttgtatctcttacgaatattagccatagcccactttcttcgatttcagatgaaatgttagtggctgcaaggcctgaaggccctctcactggcggtgctttttcttctaaagttggtgctttgttgcttgttgatgttttgattaacacacttttagatgtatatcctgaatattcagcctccgtatttggtactgcggaagtgattttacctttaatggatagttaagcagtatttaacaagtttgaaacccatcaggatatcgatgggtttttttagcgcatttagtgaagataatttttacttttattaatggtgaagaaattaatcttcaaaacaaggtgttaatgttcagtttctcattgaacacctgacaaaagtatggatagcaattaataaggacaaattaatgaatatgaaaactctattgacttacgctacgttactttctgtgacagcatttagtcatgtggtctatgccgataatcaatggcctgatttacctactggatttaaagatggggttggtgcacaagttggttcaaaagtgtatgtaggacttggatctctggggaaaagcttttatgtacttgatttgaatgcattatcgaaaggatggcaaaagattgctgattttaccggtgctgaacgaagtggagcgacggcatctgtaataggaaattatatttatctctttggtggctccggcaaagcagaaccgtctgatccatcgcctattttgtttgattcggtatatcgctacgacaccaagaaagattcatgggagaaaatgaatacgacctcgcctgtaggacttcttggtgcttcttcttattctccggacaatagacagatcctcttttttggtggttataacaaagcctattttgatcgctatctgcgagatatatcgaccactgacaagcaagtaaatcctgaagtatggcaacgtattgttgatgattatatgggaatgacgcctacggattataaatggaaccgaaacgtgatcagttatttgcctgaaaaacaagagtggcgtgatttaggcgtgtctacgtatctccctaattgtggtagcgcaaccgttattgaagggaacaaagtaactctcatcagtggtgagataaaaccgggtttacgcaccgctgaagttaagcaatatgaatttggaatggatcaaccgtggaaaagtttgttgcccttacctgcaccccaaacgagcaatatccaagagggtgttgcaggtgcattttctgggaagacaaatggagttgtagttgttgctggtggagcgaatttccatggtgcgaaacaagcatttgaaaacggaaaaatgttcgcacatgaagggctgcctaaggcgtttaattccgaaatttatgtagaaaaagagggcatttggtcaacggtaaattcgcttcctgagggcttggcatatggggcttcatttactacatcagagggtgttttaattgttggtggagaaaaaagtggtaaagaaatgagtcataaggtttatatgttggcttggaatggctctactgttgaagtgatagactaattaaggagagcattatggcaatctcatttcaattactccctgagcttccagtaggagttaaacacggagtgggtggaataataggtcaaaaattgtatgcagggcttggtagttctggaaatgcattttttgttttagacctaaaagatatgaatagtggttggaagtcggctgctgactttcctggaattgctcgaaatgatgctgcctatacagtctgtggtaacaagctttatgttttttcaggtgcagggatagagggcaataacagctttccaacagttttaatggatggttatgtatttgatagtcaaatcaatcaatggaaacgattagagagaacacttcctaccggatttcttggtgcatcttgttgtagtctatcaccgacggagatcatttttttcggagggtatgataaggatacttttaataacttcctttctgaaatctcaaaaattgatgtaacaaaagagcctaataaatataaagagcttattactatattcatgtctcagccaatcgataactataattggaataaaaatgtttggtcatttacaccatgcaatgaacactggtcagttgttggtgaaaacccatttaagcctaattgtggttctggaataattcataaaaacaacgttgtaactttgattgaaggcgaagtaaagcctggtctgagaagcttagaaactaagcgctacttgtttaaagaaggaaaactggaatattctgatagtagtgcctctattattgatatatgtaaaaatcatgaaggactagctgggcattttttcggtgaaattgacaataagataattgttattggtggggcatattttattggtagtcaagacgcatttataaaaggaaacttatatgcccataatggcctcattaaacactttagttcgaatgtttggatttttgatggtaaatcctgggagaataaatgccaattagatgctgcaggtattgcctatggcgtttccgcttcaaacggaaaagctatgtatgttttagggggagaaaactctaatggtgatgcaatgacaagatgcttatcattattaatggattaattttttatagttatgcgcttcgtcattaacaatgggaatgaatgtattaaatgtttcaatgaacctactccaaaacgtaggatataagctcatcccgattccccagcacaatctgttgtccttgaggattagatttttgtacatggatatcaatgttataggtatcaagcacatagcgaacgagtgacgcgttggtggcaattcgcaaaacgccgtcactcatcgcataatctttttctatcaccgcgcgttgtttttcatttaggcgaagatcggggatgagttctacgttcactttggtattccaaagtacatcgtcacgtttaccgtgtatcgcattattgttgatgtcaggaataccttgtatgcggcttaagacaaaatcacgatagccaccagcctgttcacaataagcgcgaacgtgccagcgtaatggtgtgcaaacaagagtatgcggggaaataatgcgctcagattgctcaccatcttttagcgatgtgtagcaaatatcgacacgttttttctctcgtatcgcctgcaccaaaggacgtaatacttgtggcgaaatgttgcgtgttactgggcgaaccatagtggaatgttcaaagcccatatcgagctcattaaaagtgaccgtcatatcctcactacgcgaaagaatatgcaagtattcatcggcatggccggaggtgagtttagggctaaagctatcactgggcttatagcctttgaggtgcttatcgtaaaccaagttgccaggtgcaatatccgcaagataagtattgatgtctttagaagcttgttgacgcccgataccaaagctctggatcagatggttggtggtcaaacgcccttcccataaagcaataatctcaatcattcggtatcgaaacagcagatcccatcgaattggccatgcactcattgttagattcctgtctagttattcgacatgttcatgtattcagtatttacctgtcgctattggcgttacattatggtccgattaataaaacatcaacaactgctgggggaatattgtatgaatgtatcgatagaagagtttactcattttgattttcagcttgttcccgagccttcgccgcttgatctggtaattacagagtcgctcaaaaatcacattgaagtaaatggcgttaaatctggtgctttgctcccattaccatttcagactggaatcgggaaaacttacacggcactaaatttcttactccagcagatgttagagcaagtacgaagcgagctgaaagaagaaaataccggcaaaaaatccaaacgcttgctgtattacgttactgattcagtagataacgtggtaagcgcgaaagcagacttgttgaagttaattgaaaagcagacagtcaagggtgagcctcgcttcactttagaacaacaagagtaccttaaagcgcaaatagtacaccttcccaaccagtcagagcagctattgcaatgttctgatgcggtattgaatgacgtgttaatcggatttaacttgaacgctgagcgtgatgttcaagcagagtggagtgccatatcaggtctaagacgtcatgcgagtaaccctgaagttaaaatctctttaaataggcaagcgggttacttctaccgtaatttaatagaccgtttgcaaaagaaacaaaaaggggccgatagagtattgttgagcggttcgttgctagcatccgttgaaacactattgccgggtgaaaaaattcgtaatggaagtgctcatgttgcttttttaacgacaagtaagtttctgaaaggcttccacaatactcgttcgcgttacagtccattgcgcgatctaagtggtgctgtacttataattgatgaaattgacaagcagaatcaggtcatcctttctgagttgtgtaagcaacaagcgcaggacttaatttgggcaatcagaactttaagagcaaactttcgagaccatcaacttgagagctcgcctcgctacgacaaaattgaagatctatttgaaccgctccgtgagcgacttgaagagtttggcaccaattggaatctagcgttcgcatttaatacggaaggtgctaacttgaatgagcggcctgttcggttgttttcggatagaagcttcacgcatgtaagtagtgccactcataagctgtcattaaagtcagattttttgagacggaaaaatctcatattcagcgatgagaaagtagaaggctctctcatcgaaaaacacggccttttaacccgctttgtcaatgaagcagatgttatatatcagtggtttcttggcacaatgcgtaaagccgtgtttcagtactgggagaacgttcgtggcttagaaatcgaagtacgcgaaaatagaagtctagaaggaacgtttcaagaagctgttcaatccctgcttactcacttcaacttacaagaatttgagtctgcagtttacgagtctttcgatacgcgggggttacggcaatctgcaggtggtaaagcgaacaagttaagttctagcaagagttaccatcatacagggctaaaacttgtagaggtggctcataatcaggggactcgcgataccgtaaattgtaaagcgtcattcctaaatacttcaccatcgggtgttttagcggatatggttgatgcaggtgccgttattctcggcataagtgcaacagcgagagcagacaccgtaatacataactttgattttaaatacttgaatgagcgtttgggtaacaagcttctatctttgtcgagagagcaaaaacagcgggtaaataattattaccatagtagacgcaactataaagataacggcgtagttttgacagtcaaatatctcaatagccgagatgcgtttcttgatgctttgttggaggaatataagccggaagctcgatcaagtcactttatcctaaatcactatctcggtattgcggaatcagagcaggcatttgttcgtagttggttgtctaagctcttagctagcattaaagcgtttatctcatcccctgataatcgttatatgctgtcgttgttaaaccgcaccctagatacaacacgtcagaacattaacgatttcattcagttctgctgtgataaatgggcaaaagaatttaatgttaaaaccaagacattttttggtgtgaatgctgattggatgagattagttggctacgatgaaatttccaagcacctaaatactgagctaggaaaagtcgttgtatttagcacatacgcttcaatgggagcaggcaaaaaccctgattatgcagttaatttagctttggaaggtgaaagcttaatatctgttgccgatgtcacttatagcacgcagttgcgaagcgatatagacagtatttatcttgaaaagcctactcagctactcctgtcagatgattactcgcatactgccaaccagctttgtcaattccaccaaattttatctttgcaagagaacggcgagttgtcaccgaaaagcgctgaaaactggtgtcgccagcaacttatgggtatgagcagagagcgttctttacagcaataccaccaaacaagtgactaccaaagtgcagtaaggaaatacattgagcaagcggtaggaagagcaggaagaacgtccctgaaacgaaaacaaattctcttgtttgttgattctggtttgaaagaaattctggcggaagagagtcgagacccaagtttgttttcgcacgaatatgttgctttggttaataaagcgaaatcagctggtaagtctattgttgaggaccgagctgttcgacgtttattcaatcttgctcaaagaaacaataaagacggtatgctatcaatcaaagccctagttcatcgtctacataatcaaccagcatctaagagtgatattcaagagtggcaagacattagaactcagttgctccgatatccgacggtggcctttcaaccggagcgattcaatcgattgtacttacagtctatgacaaaagggtattaccgttatcaaggtaatttagatggtgatccgaatagcttcgagttctttgatagggtgccttatggcgacatggtgtcagaggaagattgcagcctagcgacgttagtacagaaccaatatgtgaggccgtggtttgaacgcaaaggctttgcctgttcgtggcaaaaagaagcgaatgtgatgacgccaattatgtttaccaacatttataagggagccttgggcgagcaagcggtagaggcagtgctaacagcattcgattttacctttgaagaagttccaaattctatttacgagcgatttgacaatagagtcatatttgcagggattgagcaaccgatctggctagacagcaaatactggaagcatgaaggtaatgaaagcagcgaaggctacagttcgaaaattgcattggtagaagaagagtttggaccttcgaagtttatttatgtgaatgcgttaggggatacttcaaaacccattagatacttgaactcgtgcttcgtagaaacctcaccacagttagctaaagttattgagattccggcactaattgatgatagcaatgccgacaccaaccgaacagcagtacaggagttgataaaatggttacaccacagctagaaccttcctcgcaggggcccttatcaaccttaattgaacaaatatcaattgatactgattgggttgatagaagcttcgcgatttactgtgtcagttataaaggcatagacttctcagaacgacctaagcgtttggtgacattggcgtctgaaacctataaatcaggaagtgtctattgcttagtcaaaggtgccaataaagaagcgtgttattgggtgttgttaccaaaggattcaaagttagatctcaaagatacgtctttggccattaaaccaagtagtgctgccgagctacctacatggcagttggctcgtttattgattaaagcgatacccaaagtattgagtggcacaatgcctgagataaagcgctttgaaagtgaaggtttgtattatttagtcaaaagcaaaaagttaccgaaagatcactctggctatgaattaacgaccgtcgaaatcgacttagctccatgtgcagcacttggattcaaacaaacactttcaatgggcactaaaacattttctcccttgtcttggtttacgctagagaacggagaagtacaaaaaaaggcaaggtttgctacacgttatcaacttgacgatgttgggaagttggtcagtaaatccataaagggcgactacatcaagaagccgctttactctaatgcgaagaatcgaattcaggcgattgatatcaccaaagaatcttatagcggttttcaattatctaaggtcggtattcttgaacagtttatgcaagatcttaagcaagcttatggtgattcagtatccgtgaagttgcagcggattcccggggaaaagcacagatttgtttcagatacgattgtcaaaaatcactatgtagggctgtttgatgcgttgaaagagcatcgtttggtgatctgtgatttaaccgaaaaccaagacacagacgctgcattaaccttgcttcatggtatcgagcatctagatataaatgcagaaatagctgaagttccgattcgtggggcattgaatatcctaattgttggtaataaagacacctacaagtcagatgaagaagacccgtatcaggtttatcgcaagaagtaccaagatacggttttccagtcgtgttacccagagcgcttatggaaccgtcaaggccagccaaaccgccatgtggtggaagtgctgttaaaagaactacttatcaagctagaagtccatacaagaaaacatttgattgagtacccaagtgggcctgaaagatgtgtgtattacatgcctcagcgaccaaaagacgagtcttcagaggttcgagacgagccgtggccagtgtatgcgtctaagttagttggcgatgaatggcaatatacacaagcgacccaagaggagcttgaagatattgaactcgatttaggtaatgataaaaggcatgtatttcatgggtttgaacgttctcctgttatttattggccggagacgggggactatgccattttcattgacactggcattcaaatgcttccggaatttgaagcggttgcagagcgattgcgtgaactcaaagaagggcgatcacaagatgtcccgattgcattgttggctcagttcattgaagaaaacccagagagtaaagtaataaacaaactgagagcgatattgtcagagtgggatgatgtagcacctctaccgtttgatgagttttctacaatcgcgtacaaaagcagtgatgaaaaacaattctatgattggctgcgtgaacaaggattctttttaaaaacatcgataagagggcaaagtgagggattctttaatgcatctttaggattcttctataaccgagagcaggggatgtactttgctggtggtaaaggcagcccacaaagtaaaatcgagacctttagccatttatacctgataaaacattcgtttgatgcactacctgaagaggtagaaaacttgtttgacgtttatcacttaaggcatcgcttaccaaccgtaacgccttatccatttaagcatctacgtgagtatgttgagatgcagcgttttagatcttgatagcagactaaaccacggtgctagtaacgagcagaaacgcatgttttattcgctactagtgccaaaagtcagtaaaattctgcccaatcatccctattattgtttgaatttcaagcaactattgctttaagaagaaaattatggaccactcagtacataacaaactcgtttcatttatttggtcgattgccgacgactgtcttcgtgatgtctatgttcgtggtaaataccgcgacgttatcttgcctatggtggtgctacgccgtctggatacgcttttggagccatcaaaagaagcagtactggaagaagtcagattccaaaaagaagagatgaatgaaattgagcttgatgacgcaccattatgcgctacatcaggttatgtgttctacaacacgtccaagtggactctgcaaacgctattcagtacagcgactaacaaccaacagattctgctggctaacttcgaagattacctcaacggttttagcgaaaacgtaaaagagattgttgagtgttttaacctgaaagcccaaatccgtcacatggcagggaaagacgttctgctagatgtggttgagaaattcgtctcgccgtacatcaacttaacgccagcggttaaagaagatcctgagggtaacaaactaccagcactcagcaaccttggtatgggctatgtatttgaagaattgattcgtaagttcaacgaagagaacaacgaagaggcgggggagcactttactccgcgtgaagtgatcgagctgatgacgcaccttgttttcgatccaatcaaagataacttgccactttctatcacagtgtatgacccagcatgtggtagtggcggtatgctgacagaaacgcaaaactttgttgaagagaaatacccagcatcaaaccgtgatatctacctttacggtaaagagatcaacgatgagacttacgctatctgtaagtcagatatgatgatcaaaggtaacaacccagaaaacatccgtgtaggttcaaccctttccactgacgaattctcatctaatcgcttcgatttcatgctctctaacccgccttatggtaagagctgggcgagtgagcaaaagcacatcaaagaaggcaaagaagtcgttgatggtcgctttaaagtgaagttaaaagattactggggtgtagagagcgagcaagaagcgataccacgctcaagtgatggccagttactgttcctgatggaaatggtcaccaaaatgaagtcgccgcaagacagcccattgggttcacgcattgcgtccgttcacaatggttcaagcttgtttaccggtgatgcgggtagtggtgaaagtaatattcgtcgtttcatcatagaaaatgacatgctggatgcgattgttcagttgccaaacaacctgttctacaacacgggtattaccacgtacatctggctgctcaataacaacaaacctgaaaatcgccaaggcaaagtgcagctgattgatgctagcttactgttccgtaagttgcgtaagaacttgggtaataaaaactgcgaattttcgccagagcacattgcggaaattgtctcgacctatcttgagaatcaatctgttgaacgtgctattgatgagaaaggcgatccggtcggtattgccgcgcaagtattcaagaaccaagattttggttactacaaagtcaatattgagcgcccagatcgccgaaatgcccaattccgcgctgacttaattgagccgttacgttttgaaaactcacagcgtgaagtcatggagtacttgtacgccgaatatggcgagcaagtctatgacgcaggttttgttaaagggattgaaaaagagatcaccaagtggtgtgaagaaaatgatatcagcctaaacaaagcggcaaaaaccaagttgctggatacgaaaaactggattaaacaacgcacactggtgaatgtagcgagtcaattacacaaaaagatcggtgacgaagtttacaacgactttaaccagttcaaacaattagtagatgcagaacttacatcactcggccttaagctttcagcaccagaaaagaaagccatcttggatgcggtaagctggtatgacgaaaatgcagaaaaagtcatcaagaaagtcgccaagctaaagcaagataagttagacgaactgctagaaaactacgaatgtgaactgcaagatttgccagatttcgggtactacccaacgggcaaccacaacgagttcgtgacttatgaatcaagttcagacttgcgtgatagcgaatccgttccacttgagcaaagcatttaccaatacttccttgatgaagtaaagccgcatgtagatgaagcttggataaatcttgaatcagtcaagattggttatgagatcagctttaacaagtacttctatcgccataagccactgcgctcaatggatgaggtcgctggtgacattattgcgcttgaacaaaaagcggaaggcttaattgctgacattttgggcatctctgtggctaaggttcaggggtaagctgatgagcaatactatgattaagaagatgcccaaatacgagtcttacaaagactcttgtgagcaatggattggtgacatccccgctcattgggaagtttataggttaaaaagcgctgtatatgagtgctcaaatggtatttggggaagtgatcctaacggtagggacgaaatagtcgtgctgagggttgctgactttgatgatcacaaactcaaaatatcagatgaaaaacttacttatcgctcaattccagcaaaagagcaccaggggcgtctgttaaaaaatggagatttgctgatcgaaaaatctggtgggggagataaaactctagtcggaagagtagtattgtttgataaacaatacccagcagtaacatctaattttgtcgcaaaaatgacacctaaagagtgggttatatctggattcttgaagtacgtattttctgctttatacaataatggagttaactatctttctataaagcaaactactggcatacagaatctcgatgctagctcatatctaaatgaaaaattttgtatccctcaaaaagaggagcaatatgaaatagctaagtttctcgacaacaaaacgacacagataaatgaagcaatcgcaatcaaacaaaagcaaatcgagctgctaaaagaacgcaaacaaatcatcattcagcaagcagtgacacaaggtttgaatcccgatgcaacgatgaaatattcaggtgtggattggataggagctattccagggcattggatcgtcaaaagagctaaataccttttagatgaaatcaatgagcgttcagagacagggcttgaagagctactttcagtttcccacatgactggcgtaactccacgatccgagaaaaacgtcaccatgttcatggcggaagactacacaggttcaaagctctgccactctggtgatctagtgatcaacataatgtgggcatggatgggagcgttaggtgtatctgacagaactggtattgtgagcccatcatatggcgtattccgtgaacagcgcgagggcacttttgtacctaaatatctggagatgttgctgaaatcaactaagtatgttgaatactacaacaaggtctctacaggacttcattcttctcgattacgtttttatgggcacatgttgtttgatatggctttgggctttcctccttatgaagaacaaacacaaattgttgaatacataagcagagaatgttcgaaagttgatgaagcaataactgttcaggctgagcaagtaagtaagctcaaagaatacaaaaccactctcatcaacagcgctgtaaccggcaaaatcaaagtaacggagctggcgtaaatggcggttgttgttgccagttgcacactggataagctgttttctaatgagtcgattttagcttctgacggtaaagttcaaaaaaacgttcacgggatgcttgccatccctgaatatcagcgtccctatcgctggaatgaagagcaaatcacccgtctattgaaagatttcaagcttcatcagcaagagttaaatgacaagcttgaaacagagcattgcccattctatttaggtagtgtgattctgcatcagcagggtgacaagctgaatatcatcgatggtcagcaacgtttgaccacaatggcgttgatgtcttatctagcaaataaacatgtcgatcttaaactagtttacgaatcgcctgagagtcagcagcaaatcaaacacaatcttggttggttgtatagaaatgaagcctctttggctgatatcgattttgctcaaatcaatattaccttggtggtgacagacagtgaagatgaagcctaccgcttttttgaaacccaaaacacgggcggcgtgcgattagccgggccagatattattaaagcgcaccatcttagagcggttgatgagaaagataagtctgcggtaaacacctttgccacacgttgggaagcgctgggggatttaaaccccgtggtcgatattttgctacgtggtcgctattggcaatatctgaacttccgagactacccgctgcacaaccaaactcagcaagtgcgaaatagtattgtcaccgaactggcagagcacacaggcaaaggcgacgatattgcctttggtagaattgctcgtacttatatgcccaacggtggagagagcttggcacagcctcaagttggctatgaattgcgccagccgctaaacagtggcgctaataccattcactatttgcaatattttgagcaactgcgccaaacctatttgctgaaaaactcaacgcaaggtgagcttgcaggcttttacgagttctatcaaaagctggtgtgtaaacttgatggctgcggctatctcaaacagctttatgacgcttgcctgctgctctacatcagtcagcatgggcagcaaagcctagaggtagcagcgaaaaaacttttccgcgtggtttactctcgacgtgtagagaaccaaaaagcagtaaaagagaaatcggttcctgcttttgtcaaagaaaccccagtgctggattggattgcgatgagctataccccagagcagtgtttcgcacagcttgatggttttaagctgtcggtagacaagagtggctttgataaaaacagcgttaaaaaacgtttcgtcgaaaaagtgtctcaatactttggccttgatatagacaagcaagattatgccaatcaatttggccctgcatttagccaacacatctctgcgttaggagcaaaacatgggtgatcatttatcggtgcaaactgagcttctgacgcttgagaaaatctacaccgacaactaccagttctctattcccagctatcaacgtccttatgtctggtcagatgatgatgtcttgctgctgttcagagatattaaagaagcgtgtcgattaaaagagccaaactactttatcggcaccatcctgtcgtctcgcattgaacaagatggagagcggatctatgagttgatcgatggtcagcaacgcacgacaacgctaatgctcatgaccattgctttcaagtacgcaggcattaaatccgatcttgcagggcttgctgtttatacatcgagtgatggtgaagataagccacgtctccaattttcaattcgtgagcaagttcagcagcttttaggtggtctagcggggcttaagaactatcaagtgccgtctaaggaaacgatcgctgacaatgcttatttgaaacagatgggcgtggcgttagacgtattgaccaaagaagtagagaagctcaaatcagacgatggggtgagcgccgaagctatgggggattacctctaccgccaagttcaatgggtaaataacattgtgccaacacaaatggacttaaaccgattgtttgccaccatgaataccgctggcattcaattagaacaagcggacattctaaaggcgaagctgttcaagcatatccatactgacaaagcacagtatgatgcaatgtgggtggcgtgtgagcatctggaaaactattttgaacgcaatgtacgcaaagtatttcctaatgcggattggtaccatattgaacccgaacatttggcgtcttttgatgctgaacgtttcgctgcaaaagatgaaacgtcagaggcgttgtctggcttgtcgattgctgagctagcgtcacaagttaaagcaagttcaattcctgataacaccgagcaagagaagtttgaaacttacgacttggacgttgaaacagtttattgtcgcccgatcatcaagttcccgctgttattgattcacgcttatcgagtctacttagcgcttaatgatcataatgatattgaaccacgtctgcatagcgatcgcttgttggagatattcgacccacttatcaacggtgatgagcaatcggtaaagctgtttattgaaacgctatggcaggttcgctaccagtttgaccgttgggttgtaaaatgggttgaacgtgatgatgcgacagatgcgcagctcggcttaacgtatcaatctcgcagcaagtcgaatgacacttactacatcaaccgaacgcagaaagagctgacggatattgtgcttttgcaaagtgttcgcaactttaccggtgagcgcagcgcccagtattggttaacaccatttctttcaggcttgatccgttcgagtatcaagcaagactctgtcgcgttagagctactagaaaacattgacaacaaaatgtcattgtctgttgatactcaaaaagaggccagctttgcactcgctgaaggcatagagccaaactgccagagttggcaatctcaatcgacatattttgcaaagtcgttaggtacgagctttgagcattactggtttcaaaaacttgaatatttgatttggaagaaaatgaaggcgtcagaatcttcattgccttctgaagaattgaataagtttaaaaagtaccggattacatccaaaaactcagtagaacatgttcatcctcaaaatgatgagtataacagtaggttagactgtgaaacgttaaactcatttggaaatctagtgctactgagtccaggtgaaaactcgtcttatagcaatcaagatgttgacaagaaacgcatcgacttcgagagaaaatcccactttgacgcactgaaattaagagagatattcggtgtgaaaggtcagggactgtggggcaaacagcagatagataaccatctagaagacatgatggcagtatttgctcagcactataaacatcaataaaaacttcgagtcatcaaactaaacaacgtggtatttatggttagtaaaacaaatgaacaggcgctagaggccgcaatcgaaaaaggtttagcaggtatttgtaaagaagagttagcgctgggtgaagcgcctcttaattacaataatgatctttatcttattggctctccaagtgactttgacaagcagtacgctttagatacccgtttgttttggcaattcctcgaagatactcaagcgagtgagttagaaaaacttaagcgcaccagccctcacgattggcagagaaaaatccttgagcgtttcgatcgtatgatcaagcgccatggtgttttgcgactattgaaaaaagggctagacgttgacgatgcctttctatcgttgatgtacccggcaccactcgccagtagttctgagaaggtaaaaaaagatttttctgccaacctgtttagtgtgactcgccaggtttgttattccaatgcaaatccattggaagaaattgacatggtgctttttatcaatggtatccctctgattacccttgagcttaaaaacccatggacgggccagaacgctgtttatcatggtcaaaagcagtaccgcgatgatagagatgcaaatcagccattgttgaactttgctcgttgcttggttcacatggcggtcgataccgatgaagtctatatgacgactaagctggcaggcaaaaataccttcttcctgccgttcaacaaaggcttcaactttggcaaaggtaacccgattaatccacatgggcacaagacggcctacttgtggcaagaggtattccgcaaagaaagcatcgccaatattattcagcactttattcgtcttgatggcagcagtaaaaagcagttggacaaacgaactttgttcttccctcgatatcaccaaatggatgtcgtacgtcgcttggttgatcactgctcagttaatggtgttgggcaaacgtatttgatacagcactcagcggggtcaggtaaatctaactcaattacatgggcggcgtatcagctcatcgaaacttaccctattagcgatgatctaccaggaagtagaggaaaagaaatgcctctattcgattcggtcatcgttgttactgaccgccgattgctcgataagcagttacgcgacaatataaaagagttctctgaagtgaagaacattgttgcgcctgcgtttaaatcgtcagaactaaagtcagcattagagaatggtaagaaaatcatcattaccaccattcaaaagtttccctatattgtcgatggtattgcagacttaagtgataggcgctttgctgtcatcattgatgaagcacacagttcgcaggatgggcataaccaagataagttaaatgaagcaatggggtttgtttcggaggatgttttagacaaagcattacaaagtgcgaaaaatcgtaagatgcgctcaaatgcatcttactttgcattcaccgcaacgcccaaaaacaccactctagaaaagtttggtcagcgacaagcagacggaacttatgttccttttcatttgtactcgatgaaacaagccatcgaagaagggtttatcctcgatgttattgccaattacacgacctataagagctactacgagattgaaaaatcaatccaagataaccctgagtttgacagcaaaaaagcacagaagcgcttacgagcgtatgtagaggcaagccaagagacgatagacactaaagccgagatcatgcttgagcatttcatcaagcatgtcgttaacggcaagaagctaaaaggtaaaggcaaaggtatggtggtgactcaaaacattgagtcagccatacgttactatcgggcactaaccagacagctcaataaaatgggcaatccgtttaaagttgccattgcattctctggctcaaaagaagtcgatgggattgagtacacagaagctgacattaatggtttcccagaaggtgataccaaagattactttgatgtgaactacaagcgtaaggagccggactctccaatccctaagcacgtagaccaagatgcttaccggttgctggtagtggcgaataagtatttaacaggctttgatcagccgaaactttgtgccatgtacgtggataaaaagttggctagcgttttgtgtgtccaagctctgtcacgcttaaaccgttcagcgccaaagtacggtaagaaaacggaagatctgtttgtgttggatttcttcaactcagtggatgatatcaaaaccgcattcgaccctttctatacatccacaacgctttctgaagcgacagatgtcaatgttcttcatgagctaaaagatgatatggacgacacagatgtttatgagtggtttgaagttgaggagttcaacaagcgtttctttgaaggacgagaggctcaggacctaagcccaatcattgacatcgcagctgcgcgttttaaccacgagttagaactagagaacgagtttaaagtcgatttcaaagtgaaagccaagcagtttgtgaaaatctacggccagattgcatctatcatgccttatgaggtcgttcagtgggaaaaactgttctggttcttgaaatttttgattccgaagctttccgtcgaagacccagataaagaagcactagactcattactagattcagttgatttgagctcttatggattacaaagggttaagcttaaccattccatcgagctagatgactctgaaactgagttagatcctcaaaacccgaacccgcgcggggcttatggtcctgaagctgagaaagatccgttagatgagatcatcaaaatctttaacgaacgctggttccaaggctggagcgcaacaccagaagagcagagagttaagtttgtgaacattgctgagagcatccgaaatcacccagatttcgaagctaaataccaaaacaacgcagaccctcatacgcgagagttagcgtttgaaaagatgttgaaagaaatcatgcttcaacgtcgtaaagacgagttagagctctacaagctgtttgcccaagacccagcttttaaagcgtcttggacgcagagcatgcagcgtatggttgggatgtaaagtcccaatattgaagaacatatttattaaataactaaatttgaatgaccgatagccttaatctttccagtttatggccagacttgagcagtctaaatgtaatgccacctcaaactcctgatcaattgagtgctttgtttgtggttattttatggggtgtcgctctatttttcttaatttggtcagttgctgcatttattcgcgcaagacaacgagtagtttggcttaacaaatctttggatgatgcggagaaatcgactctgtcaggtgttcgaaatgatttaatttctagagctgaacaaaaaaaagattcagtagggcatttatggctcgagtttgatgaaacattgcttgaagtaaaaggtgctgatgacgttgttcgattgcataacacatttgatgctgactatttttttaatagttctagtttagctggtggtagtactgaaaacagaatgattgcggtggttccaggctttttaacggctctgggtgttattggtacttttgtcggtttacagctaggactttcagatctcaatatcgcgggcaacgttgatgtcaatgaaatgaaaaatggcgttgctggagttataaatggtgcaaaaatcgcatttatgacatcggtttggggcgtgctactcagtgttgcatttaatttcattgagaagatacttgagcaaattattagaaagaaaattaagtctttgcaaaaccgtattgacaggatgttccctcgattaagtgcggaatatcaactgcaatctattgcaaataacagccagcaatctcgagaaagcctacaaggacttgctgagaaaataggcgagaaaatgcaggagtcactcattcaggcaactcagggtattcaacaaggtctcgagagtagtctggaaaaaatcatggctccggctatcaataagctcgttgacgaaacatctgacgggaatcaaaaagcactggaaagcgttcttcaatctttcatggagggttttggtcaacaaggcgaacaacaacgtgtcgcgatggactctgcgtctcaaaacgtaaataagacgctagaatcaatgagcgtttcgatggctgctttcgtcaataagttggaagttcagcaaaacgcatcttcagaaagagagaaagaactgatctcaactatttcagttcaagtttctgagctagttactcagggtaatgagcagaagcgtgttctaacagagtttgtagaaaaacaagtctcagagttaggtgagcagcttactaaaagagaattagctgcttctgaacgtgaacagaaattggcttcctcaatggaaagtacgattaaagatttagtagaaaatgtttcagcacaaagccaagtcttgaccgattttgttcagaatcaagttgtccaacttacccaaacgttctccgaacgagatggaatggcaagtcagatggaaaaagagcgtaatgatatatttgtgaatcaaacgcaggcgatgaaagctggaacggatgagcttcttgctcaagtgaaagcggcgactgaatcacaacaaatcacaactaatagtattattgagcaaggtaaacaattacaaaatagtatcgattcctctgtttcggcatctgctcgagctacggagagtatgcagcagtcggcgaatgagttacgagttgccgctgatagtatgaatgtgtttggttccaacatcaaagatgcgggcaacaaactatctggtgctgttactgaagcggttaacagcacgaaggatttagcggaacaaaaccatctaggcgcagtgaaagttcaagcgttgagggagcagttgctggaagatacaagtaagtttagcgcgattgcagatcagataaacaatatgctgattagtgcagaacagtcgtttagcacgcttcgtactacccaaaatgagttccttgcagaacaaaaaggtaatctaaacgaactcacttcagaaatgaaacgtaatgtgaaagagttgacggagcaaatggctcaactgcttgaagattacgcagagcaagccaatggacaaaccgccgagcacctcaaagtttgggccaatagtagcacacaatatgcagagagcatgaatacagcagttagagctatttctagtgttgtcgatgaaattcaagataaagtgagccaacatgcgtagaggtgttcgttcgcatacacaaaactcagtagatgaagaaaatccctactgggtttcattttccgatctaatgtctgctttgcttgttatatttatacttgcagctgttgctctgattattgaattaactcaaaagaccaatgatgtcgaagctggtattgaagagcttaagcaagctgagttagcaagaaagaatataatttatgatgttcgagacgaactggctaaaagaaacgtaattgttgaaattgctgataacgatacggtaattcggattccagaaagcacactgacgtttgcatcaggtaaatcatcaattccgaacgatgcaacaatacagcaagcagttaaggacataggtgttgttcttcattctgcaattcagaagaaagaccgatttcaatatctcgataccatttttattgaggggcataccgatagcgatagtatccattacagaggaaaagggaattgggggttatctactgatcgagcaatatctgtctggaatgtctggcaaaatgaactgagcttaacgcctaaactcggtgacttagaaaacgcttatcatgcaaagctgttctctgttagtggttatgcggcgacaagacgtgccaatctacatgaggcgaatcagcaagaaaagagccagaataggcgcattgatattcgatttacagttaagaaaccatctattgctgagctcgagaggattgttggaccgtgagtctaaatataaaaaagctcaaagttagtttgcctgctaatccttttggtcaagccatcaaggactttgcacatctatcgagtcagctagaagtgctttctaagagtgccggtattgaaaacaataagttccgaactgcatatggagaagtatgtaatgcgcttgcctctaagaaaagagttgaggacgttatagatagctctgtacacgttcgcgccttagctctttcgctacatacggatgcgaagaaaaatgtcagctttacgcgcagattgcttaataaaattacagaaattgtaaaaaaaccaagctctttagtcatagagtcgttttatcagcatttcttatcagagtatgaccgactggcagacttggaagctacagcagactggttgttggaggctaaaaggctgcgaggcaatgatgagcagtttgatgaaaatatattgtcaaccaatggccccaagtggcttgcggaaagggctattcaaaataatgtcgattttgatcatttaattgcggagatgaagctggaacgttatgcaaatggcagatatttaacggcggctaaaggcatctactatattgagcagttaaacactataccattaggccaagatcatcctctcctagaggaggttcaaaaaacggtggtttttgattctcgatatgactctgaaagtttgttagggcatcaaattcttagaattttgattggccgatcgataggttctcacatcagtgagccttggatgaatgtgatcttagcaattggcggtgacccacgagtaccaagttcaaatccaagatatattaagtggtggaagagtttagaaccaaatctggttcaagctgttctcggatggttatcaaaactagacttgaagttgtttctggaagcgttggaggattattcttactcttcagctaattacgagctacagagaatgtacccatctcggaaaagtttcttagaggggatgttcgatgcgggggttatttcaaatacccggctttatttgagtctggatgctgcaaggtatttgaagagaaattatgaccctaagcacttgccaaatttctctactgttaaagatggtgacaaatcgataatttatgtgcaaatgaacggcgctcacatggttgaggggagccatagttgttatttgtggttgtaccggtatcttgacccttccgtttgtgtgtttaactataacattgatagtcctacgtactcacaactcacaatcggtataaacaatcaaatgtccagattgtcatctggtgcagttgctaaaataacgcactctccgagtggttacgcatggcaacgaaaagcacttatagcactaagagagttaggagttaaattgacgccgaaagatgtgctttcgaatgaagattatattgattttaaacaacgttatggggtgcgagagtggagttaacctctttaatcagcaagttcttctctagctcagataaaacgtctcagtttgaactcatttgtgatgatagtcttgattttgcaacttccagaaaaactctagagaaaattaaagctggtaaagctgatgagtggataacagcgcagtatgttgcacttaaaatgcttgaagagcagggggatgtaagctcatttccagatggcttcattatgcctgccgatacagctgtcagactcgattctgagttgagggatttgtttagtttgcccccggtttggaaaggagtcattgacgctgatattcaaggaaaagctagtacacccacctttaaaattgatctttcggtcacaaccaaacaaggtcgaacaacactaaattacactgtggatgggcctttcattcggtttagtcaaaatgagcagtacctgctaacacccgagcagcttatggtatttattgcgcataaaacccatgtaaggtctgataggtctgaatatgataacttactgtacttacactctttgcaagaggcccaaaagaatggttgtaagctgaatctaaagcactttgaaaggctaagaatattgacaccaaataaaatcacagtagaagcagaattgaattctcaaggcgagctaatattgacgccaaacatggggcaaagtgcgagtcatgagtcgattcaaaaggttttggggcagttgcaaagcgacaacgcagttactctgaaagtgggtgatgaaatagtcttattttctgaagaaaagctaatggctgtaaaagaagttattagcaacagggtaattccccaacagcaagttaaagcgttcctggaaaaccctacagcatatattgatgcgagtttagtcgatcttgatttaggtttttctatcagagttcatggtgcgacagtttttaaacatgcttattttggagaaacggacgagtcaggtatagattggttcggagcctcccccacatctgatttgattaatccaatatccaagctgactgatagagttcgcgataaaacaactcttgaggacgtagctaagaagattgaagatgcacgacaaaccggagcaaccgtttttgattatgaaggacaatcatacgatatcagcgatcctgcagctgttgaaaaagttctaaacgaaataggtcacaagatatctagccctaatacagatctttctagctacggagaggcagaagacgccgagactgaatcagaaggctcagaaatacatgttgttgatattgatctaaatgacgaagagctgtctgaaaattctcctaaagttgaacaactgatttctgatatttcatgggatggtgagttaaattgggaaaaccacaagcggacaccattcccacaccaggatattggtgttcgttggattttaggcgttgaacaaaaaagcttatcagactcgaaagttagtggagccttgctagctgatgacatggggttaggtaagacttttatggccctctcagcaatagaacatatttatcaacgacaacaaattagtggtgaaacgaagaaacctgcgttgatagttgctcctttgagtttattggaaaactggaaggatgaggtagataaaacctttaaacactcaccattcaaagatgtagttattttgcaatcatccgctgagttaaatgagtatcgcatggggggcgtagagattcgaggccagagcgcatctgatgattgtttagaacccaaatattctttgaaagttgggaaatactttggtcctagccgtttagatctaccagagcgattggtaatcactacttatcaaactttgcgcgattaccagttctccatgtgtttgattgattgggggatcgtggttttcgatgaagcccagaacattaaaaatccaaatgcacttcaaactcgtgctgcgaaaggcctaaaagcggatttcaaactagtggctacgggtacgcctgtagaaaacagcttagccgatttttggtgtttaatggatacagcttgcccaggacatctgggtagctatcaagaatttcgtgctcgttatatctcaccaattcttaaagctgctggtgatgaagttgaagaaataagagctaggcttggaagagaacttcgtatagctgtcggggcattgatgcttaggcgcattaaagaggacaaccttaaagggttacctctaaaacatatgtatgctggtggagaatttgaaaactggaagtatttagaagaacttaagtcgacaatggttggctaccagagagatgtttacgaaggagcgattagccatcaactcgagaatgaagaaagtcacgcgcttaccactttgatgcggctaagagatagttcgttacatcctcggttaagtgatggaggtcgccttgatattcccaaaaatgcaaaatcagctagagctctatacggagaatcaggaaaattagtttccttgcttgagactttagacagagtacgaagcaaacaagaaaagtgcattatttttgcggttaacaaacgactgcaaagtttcttaagtgtgactttggggcagatctataacctaggtccgctctcagttattaatggtgatgcaaaagccgtagcaaagcgtaaatctgtcccaactcgaaaatcaatgatttcagacttcgaagcaaaagaaggctttaatctaattgtaatgtctccagtcgcggctggtgtcggtttaactgtggtcggtgcgaatcatgtggttcatttagagcggtactggaacccagctaaagaagctcaagctacggatagggtttatcgtatcggacaggaaaaagaggttcatatctacatccctctgttgcatcaccctgaatttgaatcatttgatgtaaacctacataggctacttacccaaaaaacgttgctgaaggatgctgttgttacaccagaagatgttattccacagccagcaggtgtcgggggagtagtttctggtgatttgattgataaacgtattacagcggctgaacttgataagttaagttggcagcaatttgaagcgttatgtgtagaattgcttgcaaagattacggatagtgaaagcgcttggttgacgaacaatggtgctgatcatggtgctgatggtgtactacttaataacagtggtaatattttgcttcaggctaagtttacgcaacgacaatatgatggttataaagggatacaggagattcattctgctaaacctatttatgaatcagcaatgagaagttcttttgggcgtttgatttttgttactaattcacctttgttagctaagcgaactcatgaaattgctgccacatgtggtattgaagttttgggcagaacacagctgttaacttaccttgaagaatatgacattacactgaaagacattctgtcaaggttggggaaagatcgattaagagtttaatttcgttgattagttttggatgtaatttaaaatgtattgtcatatctagtctgaactaatacaaaagaatctagcccagagcaaaccactttcgctgagggtactttctgagagctggagcagctctcgatcaactggtcgacaagattgtctgatatgggcattctgttatccctttcaattgcctagtttcagtaacagaaaggctgcctttggcggcctcttctatatgtccgctccaccagctcatcattggctttctgcgttctaagtagtcagtacggttataggcgctacgcacttggttatcatcaacgtgggctagggcggcttctactaaatcaggattaaagccttgttcattgagtgtggtactcgctagcgagcgtaaaccgtgactaactagccttccagcaaaccccatacgtttcaatgccatgttagccgtttggctgttacagggctttttcgggtctctatccgacggaaaaataaaatctcgatggccgcttatcggtttcattacttccaatagcgccagcatctgctctttgagcggaatgcggtgctctcttctttttttcattctctcgcaggaatggttcaaactttctcatcccaatcaatgtggtcccatcgcgcactagatggcctaggcatgctggtgtgttactacttattttaggctttcagtaagtgcaaatatccagtaccagccacactgtaacttccatagctagatttttcgatatgctcactccaccagctcataagctttcgacgagagtctaaatagtcggtacggttgtatgctttgcgtatttggtttttgtcagtatgagccaatgcggcttcaatgacatcaggttcaaagccctgttcattaagagtggtacttgccaaagcacgaagaccgtgcgcggtcgttctatccttaaatcccattctgccaagtgctttattagcggtttcagaatcggtgggtacctttggattacggctagatgggaaaatgaattctctatgaccactgatgggcttaatcgcttcaagaatagccaatgtttgtgctgtcagtgggactacgtgctcgcggttcatcttcattcgctctttagggataatccaaagcttattaaccatgtcgatttcttcccaacgagcaccagaggcttcgttaggccgaaccatggtgtgaagttgccattcaattaaaaatcgtgtcacatgctggatatttgctgtagcaacggtgcgtataagatcatgcatttcatgtggttgcagggctttcatgtgcaccactttgtgttttttaaacacatcacggatgccagctaatgggttagcatgaatgacaccgctatttaccgcatagttcatgatttcattcataagttgggcggtgcgttttacagtttctagtaatccttgagactctattggccgtaatgcagcgatggccatcggcgcagtaagtttactaacgggtatcgagcccaatttgggaaaggcataaagttcaagttttcgccaattcccttccagtgtcttctcttttatttgtccttccttcgtagccttccattgctcagcgacaaacttgaacgtcgcattttgttcagtaatggtttttgctttttgttcttctttagcgagttgagggtcaataccatccgctaactgcttgcgagcctcaagggctttctctcgagcttccgccaaagacatatcgggataggttccaaacgaaagataagtgatcttatcttgtcctggtcgtttataacggaattgccatgagcgagaattgcttggacgtacgcaaaagtagagattgccgccatcagataaacgataaagcttatccttaggttttgcggtttgaatttgccttgcggttagattatttgccatttcaatccctcaagtaatacctggctagagcatgaggactccaaaaaataggtattacttttggctaataactacttaatttacattaagttacagcctgctttggtgggcggtttgaccataaagtaatacctggactggtgctcaaaagtaatactagcactagagtgggtagctgggtattactttaggtattacgaaaagcgaacgcttttatgatatcttgtggaatactactaaatagtaactatttgattttcatgaatttcaaataagaaaaaagacgtcctaggacgtctttaaacttgaatgtggcggtgagtgagagattcgaactctcgatacgttgccgtatacacactttccaggcgtgctccttcagccactcggacaactcaccgaatcgttaaccgcttggctaacgaggcgctaatttaatgattctactgtggatggtcaagtagaaatccgaaaaaaactcgcgcattgagtgcgtttgcttacaaagtagctggagtgggcaaaatcacgacaattgtgctgggttttctagaataataaggctccttgcggagccttattggttgggaagggtgaaattaaccgcctgattatgctttggcgactttcactctaaacagcacggcatagaagagcgggatcacgactaaggtcagaatggtagcaaacagcaaaccaaacataatggtgaccgccatactcttaaagaatgggtctaccagcagaggcgctacccctaaaatcgtggtgaatgcgccgagcagaaccgggcgtgcacggctcaccgccgcatcaatgatcgcgaagtaagcttctttacctgctcgaatttccgcatccgcttggtcaaccaacacaatcgcgtttttcaccatcataccaatcaagcttaaaaagccgaggatcgccataaactcgaacggagtttgaaaggcgataaggccaatggtgacacccacaacggcaaagggtgcggtcatccagatcacgagtggctgacgcagcgcgttaaacataaacaccaccgcgagaatcatcgccgcaaagccataaggagcggagagcgccaaaccttcattggcgtctttcgaggctttgtattcaccgtaccaaatcagctcatagccagctggtagctcaatctgctcgattttttcgcgcacattattgaacgcatcggccgtcatcacacccggcgctgggtcagcttgtaccaagatggtcggcatgcggttaatacggcgcagtaaggcatcttgatagacagtatcgaccgaatccaccagttggctcaccggaatgtaacggccagcttgcgcgctgaacacttcactgttttcaatcgcacgttcgtggtggcgttcattttctggtgcgcgaaccatcaacgggatcaagtcattgccttcgcgatacaccccaacattacggccattgagcgtttgcgcgatcgcggcgctgatttcttgcgtggttaagccaaggcgctgtgcttcttgtgcggaatacacgggttgcaataccggcacttgttgacgccagtcatcttgcaccgcaatcaagttcgggtcgttatgcataattgctttggcttgttcggccaattggcgtagcacgtggctgtctgggcctttgaaaccggcttcaattttcttgccgccgccgcgaccgagcataaacttccacaccttgattgaggcatcagggtatttggcatccagctcattttgcaactcgcctactaatggggcaattttggtgtagtcatcaatatcaatcagcagttggccgtaacttgggttacgcgcctcgggtgagtaggtcagcataaaacgcaggccaccaccgccgatgaaactggtgatattggtaataccgtctttttgcgtcacgtctttctcaatgctggcgacaacctgttcggtgcggcgaatatccgagccttgtggcaagtacacatccaccacaaattgtggtcgttgcgactctggcataaagcccggcggaataaactgagcgccccacaccgcagctactaaggtgccgagcagcatcgcacagctgaccacgcggtggcttaacacccattgcagtacggctttataacccgtcaccaatttagacggtttcgcctctttggtgggagctttaacgcgtagaaagtcatggcacagcatgggggtgacggtcaccgcaaacacccaactcaaaaacatcgagtagaggatcacccaaaacagtgagccagcatattcgcccatatcggaaggggagaggccaattgcgctgaaggcaaaaatgcccaccaccgtaccgcccagcagtggccattttgtggcattgaccacctcagagaccacttgctgtttatcggcgttcggctcttgctgaaaccgcacgagtacgccatcggtaaccacaatcgcgttatccaccaacatgccgagggcgatgatgagcgcgccgagcgaaatccgctgcatggcgatgtcatcaatcagcatcacacataaggtaccggcaacggtaagcaatagaacaaaaccgatgatgacacctgagcgtacgcccataaacagcaagagcacgacaaacacgatggcgacagcggcaatcaggttatcgataaaattggccaccgaagcgcgcaccgagtcagactgcatcgaaatcacatgcagatccatgcccagtggacgctggctttcaagttcagccaagcgtgctttgacggcatcgcccatctcgaccacgttaccgccggtgacattcgagataccaaagccaattgcacgctgaccgttatagcgcatcagcatcgatgctggctcggtgtagccacggctgatgttggcaatatcacctaggcgtaccaccgcattgttgctaccgaccgccacttgcaaattagtcaggtcagccaaggagctgatgttggatttagggatcaccggaatgcgcatctgctgagcatcgacgctgcctgcaacggtgactaggctctgcttttgtagcacttgcaatacgcgttcaaccgaaaggccaaattccgccatgcgttcgctggacatctcgataaagattgcttcttgctgctcggccagcgtagcggctttggccacacccggcaccagaaccagttcacggcgtagcgtatcgacgtagtcttggagctgtttgtcgctaaagccttccccagttaccgcataaaacagcgcgtacacgtcagagaagtcatcgttaacgattgaagcgccggcaccgggaggcagttggcgctgcgcatccgcgactttacggcgtaatttgtcccatacctgctgcaactgcgcggaggatttggcaaattcgagtttgatttctaccgtcacttcagagcggccttgcatcgaaaccgatttgacttcttttagctcttgcagagcttgcactgcgccttcgatgacatcggtcacttcatcggaaacttcttgcgcggtggcacccggataaggcgtcacaatcaccgcttggcgaatcacaaactcagggtcttcaaaacgacccaatttgaggtagctgatgtagccgccaatcaaggttagggctatcagcacccaaacgctggtgcgtttggcaagggtataacgtgcaatatccattattgggctccgttgttatccgtgtagggacgaacggtcatgccttcgcgtacgctcgaaacaccggcgataataacctgctcacccggtttgagatgctgagtgatcaccacgcgatctttgtaggtagttccgatgtcgacgtaacgtttttccgcttggttttgcgcattgactacccacacaaattgtttgccttggttatctggcactagggcggtcagtggtagggtgatgagcgtgttttcatcggctggtttgtcggcaaccgggatcactttagctgacatgccgggcatcacgcgaaagcctttcaaatcttcaaaaccaagcactacagagtaggtttgtgaatccgaacttggctgagtggagtaggtacgcagctttaaatcaaattgctgattgggaatcgcgcttaactcggcgatcgcgcgggtattgcgcacacctgagagcatgacacgatgcgggatctcaatcgccacttccaaatcattcagatcttgcaaaatcatgatcacttgattggcttgcacttgagcaaaattctcgatggttttttcactgatgacgccatcaaacggggcggtgatttgggtgtactccagtttgcgtttggcctcttcaacgcggtttttggcaaggtcgtagcgattggtgactttatccagctcggctttagaaatggcttgggttttctcaaaaatggctttggcgcggcggtactcttgttcggtattttttagctcaagttgcgcagcttccagcgccgttttggcatctcgtgagtcgaggctcgccagtaattggccttttttcacttggtcgccttcttttaccgcgatatccgttaagcggccactgatgcgaaaagcaagatcagcgcgctgggcggcgcgcactacgccattaaacgtgagatcggaagcgcgttgacttgcgacaatctcggttaatgcgggtttgaccacaggagcgggggcgctgatttgtggcgcttcaccgcagccagccaacaataaagccgaggcgatcaccgcgctaagcaaggagcgctttgcagccattgaacgagtaaaagaaggattcatagtgtgttgctcctcaatttcacaattgggaaaggggagtctgtacgaatccccatgcctttgacgttttatacctgcaacttcaaatcggcaggcaccttgaccaccatgtggttaacttgtcgcgcatcataccttgagtaatgataaaaagtaaactttcgggtgtacatttgtgttgggctttttattctatcgataatctgagtgtctgctcagcgagttaccaattgggtttcgatctgagttgaaagttgatctacacccgcagagagtgcttcaaccagagcggggtaacccgtatctttgagcggcacctgaaaactaaactcttggtttaacatgctttctccttttgggttgagcagttcccaattgccagccacttcggcattgcccgtgtagacaccattaaatcgctgcaatcttacctgtagtttccagtgctcttgctggatggatgaagcattcaaaggtgcaggccagtagcgagattgcttacggcgcagatcattggtgatacgttgtgtcagttgtgggctaagccgctgtgcccactggttttgtctggcttggatcacttgcgtttccgactgacgataaacaatcccttgcgtatctagataagccgccaattccacgggttgaaccaccagcaaaggcaatgttttgggctggatatgctcgctaagttctgggttgtttggcagtaaataaaaactgactttgggctgtggcgttcctccgcagccgaccaacagtgtggttaacatcatcaataaccagggtttcattcttgctttcctttcgcgggaatcggatctgctgtattactttcaccaaaaatcaaggcattaggtttttcattaatggtgcgcagcacaggtttaaattcggccatcacttggttgagttctcttaacgtggtttcaagctcacgatacaccgtcgactcaggaccaaaaccacctagggtcgtttccagttgctttaggcttgcttgaatatccgctggcagattttgtgtctcttgttttttgagaatgcgttctgccgaagccaacagcgcttctgaggtttttaacgtgctgttgagtgatgccaaagtatcatccataggcaacccgttgagttttctcagcaattcggtaacttgtttttgcacttcagcaaatccaccttgtttggtggggaataggggatacccatcgaagtgtttcaagccatctattttttcttctgggtaataatcggtatcaatgtacaaagcgccagtcactaagttgccggtttttaacgaggctttgagccctttgaaaaactcctgttgcatacgtgacttcaatgcggggagatcggctttattaaaattatcgtacaaacgacctagctcaattcgcactaggacggggatacgattagtactgatatcaatgtttgaggtacgagtacgcagaggtactttgctgaccgtaccgatacgtagaccacgatattcgaccggagcggaaggtttgagcccgcgtaccgattcatcaaacatcatcacaaactcgatgtagtcatcaaacatgccttcacggatctgttttacatcatcaaacaagcgaaactcggtcagctgctgagtaatcggctggccagaatcctcttcttgtaactggccaaaagtgactccgcctttgagtaggctttctatcgaccctaagctgaactcaagcccttcggcattcagttgaaggttgatcccggaattgagccagaagaaggagcgtgtattcaccaatttatcgtaaggggcaaagataaagagttggtactgagcctttttgctttccacatcaaactgggcactctccactcggccgacggtgaatccttcatacatgactggatcgcccacgttgagttttccggcttctttattcgtgagcactaaacgcaaccctttagcatcaggcggtgcaatcggtggtaagtccatgaccttaaaatggtcttgagcactcgaagcggttcccggttggagctgaatataagcgccagaaagtaaggtatcgagaccagaaatgccttctcggccaatgcgaggttttactacccaaaagagcgtatcttcgcgcaacatgcgatcggcatctttgctcatttgcgccgttgccacaatgtgatcgtaatcttcgctgagttttatctcagttattaccccaacattgacattaagggctttaatttgggttttccctacttcgagcccatcagctgtcggtaagatgagcgttatcttgggacccgtgctattgacgtactgaaataacatccataaccccatcgcaagagccagaataggaatgatccaaattgcagagagctgcttttgcgcagttatttcagcattaacttgaggttcatcactcatagacagttttctcattttatttttgttggtggggattctggcggctcatgccacaagattcgcgaatcaaaaaccatggctgagagcatagtcaataatactactgcagcaaaagagagcgctgccgggccgggataaatcgccatcagattatgcaactgtactaaagacaccaaaatagccacgacgaagatatcaatcattgaccagcggccaatgaattcggttacgcgatacactttgagacgttttagattctgctgctctggaaatacattgagttttccggcctgccagtagagccaaccgagtgcaaacattttggccatagggataaaaatactggctaagaaaatcaccatcgccaccggataagagccgaggtgccacagaaggatcaccccttgcataatgcttgagccttctgattttccgaggctcacggtatacatcattggataaagattcgctggaatgtaaaaaatgatggcagccagtaacagtgcccaagcccactgcaaattcaactgtggatgataagcgtgtaaacgactaccacagcgtaaacaagtgggctttttttgatctggcctgagcaagttaatctgttgacaggtgtggcaactgaccgagttgtgtgtgcaatgagtttgcccagcgttgactccttggggagtttgggcgggaataaagtgttgccacaaccaatagcgatcgactagcgaaacggttttcacaaccaacatggcaaaaaagcaaaatgcccagaaggagtaacccatcgctacctcggctagtgaggctatttttatgagactgactaatacgccaattaaaaagacatcgaccattaaccacggctgaactgtgagtaatgttttgcacaatagcttcgcgcgctggatctcggatgaagaaagttgtcgttgtgtgctttgcgcggctttaaaagagacaaaaagaagtatggtgatgtagagcgccggaaaaaggataacggtggtaaagagtaaaatggctaataaaacgttttgaaattcaccgagcattttggctgcatttaacagcgtaatttcttgggtcattccttgcacgctaaatgacataaaaggaaacgtcaggctgagcaccaataaaatcaggcaactgatggttaatgcgacagcggtttggtacggtttttgaggtgtttgggtgagcgtatgcccgcaacgaggacactgcgcagtttgtgcttggcttaaaagtggtacgttggttattagcccacactcgtcacaaccaatcaaatgattctttagtttgtccatagtcattggttttatttatcgttagtgggttggaatcattccacgaggattgataacaagccgatgttaaaggttgagagcttgtaacatttgggatttatcgcagccttattgtagcgatttattcgcatgactaaagaaaagtttttaattttcagctagattaccgctagcaaaatttgatgaggttaggtttaacaatgataaccaaaaagtgtagatacgcgatgaaaccacgttggagctgggtagcattattgcttctgatggcaaccagtgctttcgcgagtgacacgtcgcaagagaatacccaaatcgagactactactgagataacgactacggcagagtcgccctctgagcttgaaaatgagattgatcagataaagcaatatatcagtgagttgtcggtgacgctaaagcaagcaacaggcgatgtacgtgatgctttgcaacttcagctgtttcaaaaaaatgccgagttaagaaagagcctttccaaagcggtggaagaaaaaacaattgccaaagaaaagctcgtcgagctggtgaatatccaacaacggtataccgaagaggcgaatcactacatttccgaacggttgaattcgttggatgacagtctcggcaaggcatcccatgaagagaaactctcttatatcactacctatcgggagttacagcaatatctggacgtgacttaccattccagcgcagaaaatattggttggctcagtagtttggatatcgatacccgtgacgttgagaagacattaagagagcgaatcaatcaacgcttacgtctactgtcggcttcattagagtatctaaagcaacaaatcagtgtgatcaataaccagatcaaatcaagcccagagtctgaaaaggccaacttacaattggcgctcctttttactcagcagcggctggatattgtcaccaaaagcctacgttcagtggtggggattgccgatcaatttgagatagaaaccgccgactataagcgacagattttccaagtgacgggcagtattactcaggatttgttgaacactcaggtggtattttcaattgttcgtcactggtcaaattcgctggtcaactggctggcaagtaatgcggttcaacacctattccaactctttatctttttattgattctactggcggcgaagggcggagcgaaagtgactcgcactgtagtacgttctgctgtgaactcgaaaaacatccgtatctctcatttgatgcaggatttctttgtttctatgtccggcaaagtagtgtgggttatcgggattttggtcggcttatcgcagattggtctcaatctcgcgccagtattaaccggttttggtattgcaggggtgatcattggtttcgcgttgcaagatactttgtctaacttcgcagcaggcatgatgttactgatttaccgaccatttgatgtgggggattttgtgcatgcgggaggtgtggatggcaaagtgagccacatgagtttggtcaataccacgattcgtacgttcgataaccagatcattattgtgcccaatagcaaaatttggggggatgtgatcaaaaacgttacccatgaacggatccgacgagtcgatatggtgtttggcattgggtatagcgatgatttgcttaaagcagaagcagtactgaccgatatcgtaaagtcgcatcccgcagtgctaaaaacacctgagccgaatatcaaagtgcatacgcttaacacctcatcgattgactttatcgtgcgtccttgggtgaaaaccgacgattactgggatgtgtattgggatgtcactaaagaagttaagctgcgctttgaccgggaaggtatttctattcctttcccacaacaagatgtgcatttgcatctggtggatcaaaaagcctttatcccacctacacagcccacttcttagtgttggtaagtgtgactattttgtttggcagagcgatgttgtcgctctgccattaggttcaacggagggcgagatctttaaaggatgagcattggtatcttggcatttagcaaacagtgcgaagagatggaactgtttcgctgtccagatatccggcatatctacagtttttaataaaggattgaaataactatcctgctgatcagaaattaaccttaattcgacccaatcttcaattcgctcgtcgttatggaaactctcctccaatgatagaacgtgatcagccgtgggttcattgggtaacagtgcataagccaaatgatagtctcttttgagtaatagccatttatctggtagacggcgttggctgtcccaccaaataccttcgagttgctggattttttgttgagtcacactgctaggttgtgcttttaatttccgaagttcatcttcaagaagatgagcaaaaattttttcaaactcctgtttgttggcgtctggattagccagcaatacgtcacgcgccaagtttgccccgagcatattggaataaaggtcttcgggtgaaaaagcggaggcctgctcatgaaacccactgacataggttaggccaaaccactgagcaatttcatgccactgggccagttgaaatgcgatgaaagccgcggcttgagcactgcgtattaccctttctttggggtctagagagacagattggtttttccaatgtatttggcgtgaacgtaactcagtgggtaaggtgatctgagcttcatgacctagctgggccaagtttaatttaaacaagtaataggtgaaatctgcggtgtctctgacgtgtgcagtatcaataaatccagctcgtttggtaaaaatcaggccattatgttcctcgcttaagcctaataagctggttgataaagattgatctccttggttgtagtgatggcccccaagcgcatcaacatcgataacgttatccacagagaaaaagggaacaggaataccggcgacttgtgcgtggagattgtaaccaaaggcacaacatggacgaagccctataggtggagtgggtatggcttgtacaggttgaagtatggctaatagaaaacacagtagagtagtgatgaatctcatctctttttcctcaaaatgcttcgtttatctgaaaataaaatccgttgttttgcttacctacacctaaatcaatgcgcacattgattcttgctttaaaggcaaagcggtaaccgataccaagagttggcagccattcactctccgctaagtcagcaaattgtgaagctgtgctgccactacctaaccacgccaccatgccgtgtcttgcgttaaagctatgacgaatttcaaattgtgcggtagcgaagtgtttgtcacgatattggccttggtaatagcctcgcattctttgatcatcgccgagcattgcgtggtcgaaccaaggtacttcaccagtgaaagattgattaaaccattccatcgcaaagatagtttgaggcgttaatcgctgataatggcgtaagttaaacacccattgttgatagtcaaaatcgctaccatagcggtctcgataatcactccattcaagattgatatagcttcctgactgcgggttgggttcaaagtctcggctgtcatattcaagcccaattaagcttccactacttaccccaggcttaagctccgcagccgcatcccccttttttttcactgcaatcgcacgataactctgccattgccagccaactttaaggtaagtgcttggaaacagctcataagccagcgatgggttaaactgtaaccttttcgcgtcatagtgtgttttattggattcctgttccgcagccttggcaccaataccccaatagtcactcggcgcatggctaatccaaccatcgatgagcattctccattgatcgttattgagataagtacgatttactaggcctaaaccgtaagaacctgaagttgacgtgtaggaggtgatggtcacggttgaaaatggatgcccctcttgccacgttggtggcgcatagagccccactgccgcgatgccaatgcctaggccttgctcaggattaacaaatggtccagggagtatcccccaatcaatggttttactcacatcgaccgtttcacttgcccccagtttttcgagcactttatccaatacattatctgatgcttcggctaacagtgaaaaacctaaggtgattagaaaaatcagagtatttgttttcatcgcagatgactgattaaaaacgtctatcgagagagaaaaatagactttggcgatcgccaaaaccgaactcgccgagcaaataccagctgtcattgagttgatactgcatcccaaccagtggattccatgacgtttgcaaatgttgtttcacttcaaaacccgcatctttagggagtaaagcggtgagtgagcccggaaggccaagatccgatagggaaccttgtaaagtttgttcgacatcttgatacatagctcccacccaaagtcgcaatggatggccatgacgatggaagtcgtaaccgattcgcggagaaatcactatggcttcaatactgccatcgatgaccgtgagacggctttcggttaggctagcatcgaccaaggcaaaccagttctgataaccgccaaccagtacaccaccgacccctgtggtgtaaccatcaaggtcgagacgaaaattgttgatggtgtgttgtgcccctaaaaacttcatattcacatctgtcgtggagtaaccgtctagcttgccgactaagccatacagattaagaaaggggaatagccacacgtcggcgcgcagagtcaacacttcggtatattgtctacctggatccgcttgtaattgcagtggcaatttacccaggccttggatagcgattgaatcgacgttgatcccttgttccatcgtcatgtaattgagattaaagccaatcggtttgggtaattcataaccgagagcttcggctttttctttccaaatcggcagtgaaaactcactggcccaagtggtgaatggaaaacagaaaacggtgagtgtcagtagtgttcgtaatatcattcagagtgctcagcagtgttatcgtatccagatacttggggagcaatgaatctgtttgattgatggcagatttcccctaatggtttctgatccctgaatgccattttgaggcgataatacctttatttttagcacaaagtaaactcgttggtgtacttttttgtgcgtcggacttatagtgatagcggatgatattgataaccgatgaaattgaggaaatcgtggtatgaaactcagtgagcaaaaacggttggcgctgattgaagcagcaaaagaagagtttacccagtttggattccatgcagcgaatatggatcgcgtttgcgaacgcgcaggtacctcaaaacgcaccttgtatcgccactttaccagtaaagagttgctctttattgaagtgatcaatcttctggtggcacagccgcacaaggttggttttgagtatcaatctacccgttctcttgcggatcagttgcacgactactttgcggcaaaaattgacctactgtatcgaacgattggccttgatgtgctgcggatgattgtgggggaatttgtgcgcgatccagccttaacgcagcaatatctcgcgttgatggggactcaagatacggcgctgactgcgtggctgcaagctgccattaaggatggaaaactgattgagaaagaagtggctcccatggcgacaaccttgatgaatctctttcatggtcagtttttatggccgcagttgctggccgcggtggagctgcctgatgccaaacagcagcaaatcatgatggatgaaatcattcgtgtgtttgtgttgagctacggtgtatcctctccaagtcatttgagtatagaactaaagccttagaggctaacggatcactgatgaggagtcttgccatgttaccgaccgattttccattttttcaccaaagcgcctttattaatgggcagtggattttaggtgagccacaggcaaggcaaacggtaaccaatccgtttgatggctccctcattggctctgttcctttattgagtgcggctcaggtgcaagaagcgattgccggtgcgcaagcggcgcaaattttatggtgccagcaacccgctgaaaataaagcaaaaattttgcgccgttggtatgagcttattgaacagcatcatgaatcattggcgaagttattaactattgaacaaggtaaaccgctggcagaagccagaggagaaattcactacgccgccagttttgttgaatggtatgccgaagaggccaaacgtgcatatggcgagctgatcccatcccataaacctgatgcgcgaattatggtttcacgtcagcctgttggcgttgttgccgcgattacgccttggaatttccccgccgccatgattacccgtaaatgtgcccctgcctttgcagctggttgcgctgtggttttaaaaccagcgccggatacgccgttcacggctttagctttggccgatcttgcgcagcaagcgggaatccctgatggtttattgcaagtggtgacgggcgatgcgattgaaatcgggcgtgtactgacggaaagcaaaacggtacgcaaactctcatttactggctcaaccggggttggcaagcttttgatggcacaatcggccaataacgtgaaaaaactctcgcttgagctgggaggaaatgcgccgtttattgtgttcgaagatgcggacattaatgccgcgattgatggtgtgatggtggcgaaatttcgtaatgctggacaaacttgcgtgtgcgctaaccggatttatgtgcatgacgcggtatatgatcaatttgctgccaagttggtggatcgggtcagcagactcaacgtcggttatggtttggatgccggtgtaaacatcggtccgctgattaatgatgccgcggttgctaaagtcacatcacatatagtggatgcccaaagcaaaggagcgaaagtgatgtttggtgcgttgcctgaagcgggcagccgtttattccagccacacgtgttaaccgaagtgaccgacgaaatgcgcgttgctgacgaagaaaccttcggccccttggccgcactgtttcgttttagctctgagcaagaagtgatcgagcgagccaatgcgaccgattcgggtttggccgcttattgttatacccaatctttgcgccgggcatggcatatgagtgaagcacttgaagcggggattgtcggcatcaacgaagggttgatttccactacgttagcgccttttggtggcatcaaagagtcgggtcttggtagagaaggggcgaaacacggccttgaagagtaccttgaagtcaaatatacccttatgggtggactagcttaggtttgggtgtttgattgctctgcacgttcagaggtaaccatttcagcgggccattggtttcaaaatcattggcgcgctgacaagagagatacacttcaccgactaagatcacggcgccttctgaataagcctgatcttggtaatagcagacccgtttagcaatatcatcgccgatcacgatcggtagtttcgctggcgtcggtgcagcatgcaacgcgacactgtaacttaatgtcacgactaccccaatcaaagtacgcattgaaaactctccatcctctggttatacccaaactacctgcagcttcaagtagcaagggtatattcgctaaactgccgctgataacgcggcaacatactttcatttcccagtaaaccgccttggtgtagataaagcaagtttcggtctgggttctcggtacgccaagctgacaataaacgccacatcagcgggtcgtataacagatcaaattcaatatgagtttgtgccagtaacgcttgccatatctgataatcctccggataaagatgaccgaaatagtgcttagtcgtagaggtcagaaccgtcgggtgagaggtttcaccgagcattaaaaactgctcacgtaagtaggattcgtcacccacacaagggcaggtaatgacttcaacaccgtgtggttgcaaatatttgtgtaagtagagcgccgtggttccggtgccggaaggcagggcgaccacccaatctggctgggtttggtggcggagccattcgagcatttctaacgctagttgtttgattcccggctctgcaaatgggctgcgcgcaccttcctcaatcaccaagcaatcggtattgggcatgcgttgttgctgaataaattctcgtggatgcttagcccctagtgagcgcgtttcaataatggtcgctcccaattccagcgcaccacggtagttaccgattggataacttttcagccacgcgggaatatggtcaacgtaaaactccaagcgccaaccgcgcagtttagcaagggctgcaaaagagtagagcgagttagcttgtgccgaaccgtagctgattaaggtggtgatgccgggaaaatccccttcaagcaacgccatcaatttgcgggctttgttaccactgaaatgtggatgaagtttgtcatcccgtttgaggtaaaaggtttgccctgcaaaacggtgttcagtgataggtgattgagtgatcagcataagaaaatcgagctctgaatggggtcgcacattatacgcagttcgatcgcaacgactagggtttggatcaaactctctccgagtgaccacccttatgactggcggcctaaccacttatcgccgtgctctaagtcctgaatttttgactgaaaaatcgccaatgaaccgacttgaacaaaataaaccagataaaaaaacgcccaaaacaatctggctttgggcgtacacaagtataggagttaataaaaaggaaaaagcagcgtaattggtgacagcgggtcgagaaccaaatttgacggccagtaaaactctcaaagctctgtcaatcacgtctattcagactgggcgtttggcaaagagttccaaaagttcgcaaattatttttaaatttttttgtggaagacttttcatcgtgctgcaagcacttagctgcatctggtcagaccatggcgagaaaatgtgatgttaatcgcttgttaatcaaatgtggcgagagtatatttcaaacagttgtttgatacgagtgattgaaatggcattacgcagtagtactaaggaaaaaatattggatgtagcagaagggctgtttgcggaatacggcttcaatgatacctctttgcgcacgatcaccagtaaagcgggggtgaaccttgcgtcggtcaactaccattttggtgacaaaaaaaccttagttcgagcggtactcaatcgttatctcgaagctttcatgccggagatgaaacagtcgcttgagcggcttaacgagcgggacgattacgatatggctgaagtttttgaagcgctacgtgctcccttgcgttcgttaagcgaattgcgccccaatggcaccagccgttttatgctgctgattggccggggttataccgatgtgcagggccatctccgttggtttattaccaatcgctataatgatgtgctaaccctatttaccgattccgtgcttaaggcgaaccccaacttgactcgcgaaaccttgttttggcggttgcatttcaccttaggtacctgcgtctttaccatggcgtcgagtcaagcgttggcagagattgcagaaaatgattttggaagcaaagttgatcctaagtctgtggtcgatcaactgattccatacctcgcggccggtgtggcggcgaaataactaaccgattcataacaaaaataacagtgtaaccagtgaacaaaaggatctgaatatgagctctctacgcagaaaatggatcagcgatcccgctttcaaaatgtttaagaaagtgcttcctcctctgtcacaaaccgagaaagaagcgatggaagcgggcagtgtatggtgggatggcgaactgttctctggtaagcctgatttcaccaagctgcaccattatccgaaaccgaccttgtcagcggaggagcaatctttcatcgacaacgagttggaaactctgctcgctatgttggatgactacaagatagtcaaacaagatcgcgatctccccaaagaggtgtgggactacctacgtaaagagcgtttcttctcgctgattatttccaaagagtatggtggccgtgagttctcggctctggcgaactcgaccatagtgtcacgcattgctacgcgcagcatcagcaccgcagtaacagtcatggtaccgaactcattgggccctggtgagctgttgtcacactacggtacccaagagcagaaagattactggctgccacgtttggccgatggcaccgatattccttgctttgcattgacagggccggaagcgggttcggatgcgggcagcattcctgaccaaggcgtggtctgctacggcaagcatgaaggcaaagacgtgctgggcatccgtttaagctggaacaagcgttacatcacgctggcaccagtggcgactgtgctgggtcttgctttcaaactgagtgatccagagcatctgcttggcgataaagaagagattggtattacttgtgcgctaatccctgcctcccatgaaggcgtagagattggcgaacgccacgacccactaggtttggcctttatgaacggcccaacccgtggccaagatgtgtttatcccaatggattggctgattggtggggcggattacgcaggtaaaggctggcgcatgttggtggagtgtctctcggcaggacgtgggatctccctacctgcattgggtaccgcgattggccacctcaccgctcgtaccacaggcgcatatggttatgtgcgtaagcagtttgggatgtcgattggtaaatttgaaggtgtggcggaagccatgggacgtatcggcggtttaacctacttgctggaagcgacccgtactttgaccaccacctctttggatctcaaagagaaaccagggattgtcacggcgattgccaaataccacatgacggaaatcgcgcgcaccattttgaatgatgcgatggatatccattctggtcgtgctatccaagatggaccaatgaactatctggcgacgcactatctcggcgtacccgtggcaatcacggttgaaggggcgaacattttgacgcgtaacctgatgatcttcggtcaaggtgcgactcgttgccatccttatgttctcaaagagatggaagcggcggccaacccagatcaacaagaaggggcaaaagcgtttgatgaactgctgttcaagcacattgcccacgcgaccaaaaacagctttggtgctctgtttgccgcactgacgggttcacgctttattaaagcgaacatgagtggccccacacaagactactataagcagatgactcgcctgagccgcgctttagcggtgagtgcggatgtggcaatgctcaccttgggtggcgagctcaaacgtaaagagatgatttcagcacgcttaggcgatgcactgagctatctatacatgggctcggcggtactgaaaaagtatgaagatgaaggccgccatcaagcggatttagactacgtacactatgcgatgcagtactgtttgcatcacgcagcgaaatcgcttaaccaagcgtatcgtaactaccctgtgactggggtcggagccatcttgaaagggctgctgttcccgctaggcaaccactttgcaccaccgagtgatgagttagcggttaaactcgcagaaagtctgatgacccctggagcgcatcgtgatcgtttaaccgcgctgtgctacataggtaaaggtgaagatgacagcgtaggcttgatggaaaaagcgtttttggccatgtatagcgttaaaggcttagagcgtaaactgcaacaaggggtgaaagagggcaaagtggcgcgtaaaggactactggttgatcgcttggcacaagcagagcaagcgggtgtgttgagcgcagatgaagtggcttcgatactggcggcagaaaaactgcgtagccgtgcgattcaggtcgatcatttcagccatgatttctcgcaaatccatacccatcagaccaccaaacctaagttaaacagtgtggcataacaaataaaatagagtatcgagggcttctcatcagaagccctctttatttttattgattgagttttttgtgagcataacgggaaaaataccccaatgagtgctccaaccactggccattttcggcgaaattgagagaaattagatgcggtttgtgtctgaaccttttatcctagcgacgattttttaaggaagttgaatatgatcatcaaacctaaaattcgtggatttatctgtacaacaacgcacccagtgggttgtgaagcgaacgtaaaagaacaaattgcctacacaaaagcacaaggtccgatcaaaaacgcacctaagcgcgtgttggttgtcggatcgtctagcggctatggtctgtcatcacgcatcgctgcggcgtttggcggtggtgcggcgacgatcggcgtatttttcgaaaagccgggcactgacaaaaaaccaggtactgcgggtttctacaatgcagcagcgtttgacaagctagcgcatgaagcgggcttgtacgcaaaaagcctgaacggcgatgcgttctcgaacgaagcgaagcaaaaagcgattgagctgattaagcaagacctcggccagattgatttggtggtttactcattggcttctccagtgcgtaaaatgccagacacgggtgagctagtgcgctctgcactaaaaccgatcggcgaaacgtacacctctaccgcggtagataccaataaagatgtgatcattgaagccagtgttgaacctgcgaccgagcaagaaatcgctgacactgtcaccgtgatgggcggtcaagattgggaactgtggatccaagcactggaagaggcgggtgttcttgctgaaggttgcaaaaccgtggcgtacagctacatcggtactgaattgacttggccaatctactgggatggcgctttaggccgtgccaagatggacctagatcgcgcagcgacagcgctgaacgaaaagctggcagcgaaaggtggtaccgcgaacgttgcagttttgaaatcagtggtgactcaagcaagctctgcgattcctgtgatgccgctctacatcgcgatggtgttcaagaagatgcgtgaacagggcgtgcatgaaggctgtatggagcagatctaccgcatgttcagtcaacgtctgtacaaagaagatggttcagcgccggaagtggatgatcacaatcgtctgcgtttggatgactgggaactgcgtgatgacattcagcagcactgccgtgatctgtggccacaaatcactacagagaacctgcgtgagctgaccgattacgacatgtacaaagaagagttcatcaagctgtttggctttggcattgaaggcattgattacgatgctgacgtcaatccagaagtcgaattcgatgtgattgatatcgagtaagagaattaactcttatcttaaaaaggcgcgttatcgcgccttttttgtgtccggagtacagcatgaatacagcaggttgctacagtgataaagagcagcggcgctatagttgagcttgattctttgttatacccaaatcacttgaagtggcagccaacaccgcgactgctttaagtaggaagggtatatggattcttggttgaacgccgtcgatattttgcgaacgcattgattgataagtgctgtagcaaaacaaaaagcggagcataagctccgctttttgttgcgttcggaaatcagagattaacgagcacggaagacgatgcgacctttagacaaatcgtaaggagtcatctctacagtgactttgtcaccagtcagaatgcggatgtagtttttgcgcatttttccagagatgtgagctgtcactacgtgaccattttcaagctctacacggaacattgtgttaggaagagtatcaaggacagtgccttgcatctcaattacgtcttctttagccatttaatcctctttagaaatttggcgatctttaacggcgcaggattctgccattaaacgttcaatatgggaagttgcggcgtattctaccctcgccaacgttgatttactagcctttgatgtggattgaaccggactttgtagttcatagctgggcattcatcgatttgatatcccaaataaagccactgctttttggtctgttggcagtaattgagctgacaaagtaccgctaaggtgcctaaagagatcgaaatatctgggtcataaaaggtgtaaaacgcactcgcactgtttgggagtaaatcggtgacggcaatcgcgaccaacttttcgccctgataaagatgtaaatattgggtattaagccattttgcacgggcaaatttggcaaattccattttattgggtgggtacatggagccgtggcgatgacgagcgaaaatataacgcgcgtaaagggtgtaccaatcttcatccagttctggtttcaactgccaatgaaactcttggctgagcagcttgagtaaacgtttttggcttttacttggcacaaaatcgggcgcaggaattcgcagagcttggcaagactggcaatgatcacaatgcggtttgtagatggtatcgccgctgcgccgaaaaccatttgccatcagcacttcataggtttcgggggtttgcatctgcggatcaatcgccacggcgacgcgctccatccgatccgctaagtagctacaaggatggttattggttaagccaatacgaatttgctgaatatctgagctcatgcatcaatcctcaaaggcacatggcgaagtgggggtggcgagccactgagtttcaaaacagccactgagcacctgcttctccttaaaagatagcaacgattggataaattgttcacggctcaaggtcgttgcgcctaaagattgcaaatgcggattcatcacttggcaatcaatcaactgcccttgatggcgagaaaaatggtcgcaaaaataccaaagcgcaattttcgaggcattggttgcgaggctaaacatggattcgccacaaaacagttggccaacggaaatgccataaagcccacccaccagttgttcgccctgccacacctcaacagaatggcaacgaccttgtttcgccaactcgccatacgcatggcgcattgagtcattgagccaacgttgatccgcagggcgagtgagcgcgcactgctcaatcacttgcgacgtcgcgtgattgacgctaacccgatactgatgtttacgttggaacttcttcacgcttttggcaggttgaaaccgagtagggtcaaacacggcacgtggggaagggctccaccacaaaatcgggtcttcagggccataccaagggaaaatgccttgttgataagccgcccaaattcgttcaagacggagatcgccgccaaatgcaagcaggccgttagggtcatctaacgcagtaaaaggagaggggaatgtcaacgtttccggcgataattcagtcagataaatagccatcgtattggtttgccttagaagtccctgtgagccattccgaaagtgaatgagccgcgatcttagtgattttgatgaagtttgccaatcttgatgcttggaaaatcccaggcttggtcgagattgcataaacagaaataaaaattcattgcgagcaagataaaggctagcgctagcgcatgaatttggttagtctgcggatacgaagaattttcgccgcgacccattaccacaaggactttcagcggcgcaaggaaacacaacatccaatggaaagtttgactctacaaccgattgaactcatctctggggaagtgaatcttcccggttccaaaagcgtttcaaaccgtgcgctcttgctggctgcgctagcttcaggcacgactcgtcttactaacttgctcgatagcgacgatattcgtcatatgctcaatgctttgaccaagctgggtgtgaactatcgcctctcggccgataaaaccacctgtgaagtagaaggtttgggccaagcctttcacacgactcagccattagagctgtttttaggtaacgcaggcactgcaatgcgtccgctggcggcggcgttgtgtcttggacaaggtgactatgtactgactggtgaaccgcgcatgaaagagcgcccgattggtcacttagtggatgctcttcgtcaagccggcgcacaaattgagtatctggagcaggaaaactttccgccactgcgtattcaagggacgggcttacaagcaggaacggtgactatcgatggttctatctctagtcagtttttgaccgcctttcttatgtcggcaccgttggcgcagggcaaagtgaccatcaagatcgtcggtgagctggtttctaagccttacatcgacattacactgcacatcatggagcagtttggtgttcaggtgatcaaccacgattatcaagaatttgtgatcccagcggggcaatcttatgtgtctccggggcagttcctcgtcgaaggtgatgcctcttctgcttcctatttccttgctgcggctgccattaaaggcggtgaggtaaaagtgaccggtattggtaaaaacagcatccaaggggatattcaatttgcggatgcattggaaaagatgggcgcgcaaattgagtggggcgatgattatgtgattgctcgccgtggtgagctgaatgcggtggatctcgattttaaccatatcccagatgcggcgatgacgatagcgacgacggcactctttgccaaaggcaccacggccattcgtaacgtttacaactggcgcgtaaaagagacggatcgcttggcagcaatggccaccgaactgcgtaaagtgggcgcgacagtcgaagagggggaagatttcattgtgattacgcctccaactaagctcatccatgcggcaatcgatacctatgacgatcaccggatggcgatgtgtttttctctggttgcgttgagcgatacgccagtgacgatcaatgatccgaaatgcacgtcaaaaacgttccccgattactttgacaagtttgcgcagttaagccgctaaagtgtcactctctgcccaaaaccgatggcgataaaatcggtttcggaatagatgtaagtgattgaaaaaagcctcattacgaggcttttattatttttgtagggtaaattccggtgagagatgatgagcgagatatttaaacatattaaataccgctgtggttttctcagtaggaaggccttgttcagtgaggaaatactcacctttaaacactaacacgccttctttctcttccacttgagtggcacgcatgccttcgatgtaacactcatgatcttgaattaattggttagcaatcagtaaaagttcaaattcagtgatcggttttttatggctcatggtgataactccttaccattggatgcaggcattataagtaggtaaccggtgacaaccttgacagaaagcaggaaaagggcgatttgttctctaggtgaatttgtgagttattgcatatttcgtcgttttggggtcgcggtataccgcgcttcactttagtatgggcgcgtttttgacagcagaacaacatttcgtcgatttgtcgagcaaataaaaagcttttagaaaaaacaagttgatcttcttgttatctggctcgatagtaaaaaaagaattacattttagaacgtcatgcgatttaaatcgcgccaaatgatgaaggacaattgagtcaatatgggtaaatcactcgttatcgtcgagtcgccagccaaggctaaaaccatcaataagtaccttggtaaagactttatcgtgaaatccagtgtgggacacgtgcgtgatctgcctacagcagggcaaacggccacaccgaccggtaaagcggcggcagcatcgactaagaaagcatctactactgataaagagcagcagaagcgtgaaaaagaacgcgcagcgctgatcaaaaagatgggtgtcgatccgtatcacggctggcaagccaattaccaaattctgcccggtaaagagaaagtggtggctgagctgcaaaagctcgcgaaagacgctgacagcgtttatctcgcaaccgacttggaccgcgagggagaagccatcgcttggcaccttcgtgagatcatcggtggcgatgaaaagcgatataaacgagtggtatttaacgaaatcaccaaaaacgccattcagcaggcttttaagcagcctggtgaactgaatatggatggcgttaacgctcaacaagcacgtcgtttcatggaccgcgtggtgggctttatggtctcgccactgctgtggaaaaaagtggcgcgaggcctttccgctggtcgtgtacagtctgtcgccgtgaaacttctggttgagcgtgaacgcgaaatcaaagcatttgttccggaagaattttgggacatcaatgccgataccttgaccgcagacaagcaagattttcgcctgttggtagcccaaaaagacggtttagctttcaagcccgtgaacgaaacggaagccttggcggcggttgctgcgctcaataaagcgcagtacgaagtgtgcaaacgcgaagacaaaccgaccaccagtaaaccgagtgcgcctttcattacgtcaaccctgcagcaagccgcgagtactcgccttggttatggggtgaaaaagaccatgatgctcgctcagcgtttgtatgaagcgggttacatcacctatatgcgtaccgactcaaccaacttgagtgcggaagcggtcgagaatctgcgtggttacatcaccaagcattacggtgaggcgtatttgccaagccagccaaatgtgtatggcagcaagcaaaatgcccaagaggcgcacgaagcgattcgtccttcggatgtgacggtcaccgccgacgatctggaaggaatggaagcggatgcacacaagctgtatgccctgatttggaatcagtttgtggcttgtcaaatgacacctgcgcaatacgattccacgacagtcagtgtaaaagcggcagagtacaccctgaaagcgaaaggtcgtatcctcaagtttgatggttggactcgcgtacagcgcccgttgggtaaaaacgaagatcagatcctgcctccggtgaaggtcggtgatagcctaaagctcgtcagcctagatccgaaacagcattttaccaaaccgccagcgcgttacacggaagcggcattggtgaaagagttagaaaagcgtggtattggtcgcccatcgacgtatgcatcgatcatttccaccattcaagaccgtggctatgtgaaagtcgatcagcgccgtttcttcgcggaaaaaatgggtgaaattgtcaccgatcgtcttgatgagaattttgacgacttgatgaactacgactttaccgcgcgtatggaagagaaactcgaccaaatcgccgaaggtgaagtgaactggaccgcagtactggatgagttctttgctgatttcagtcgcgacctagaaacggcggagcaagatgaaagcttaggtggcatgaagcctaatcacatcgtgatgaccaatattttgtgtccgacctgttcgcgtccgatggggatccgcacggcatcgacaggggtgtttttaggctgttctggctatggattaccgccgaaagagcgctgcaaaaccaccatcaacttaggtgacgaagaaggggtgatcaacgttctcgaagaggatgtcgaaaccgcagcactgcgtgctaagaagcgttgcccaatttgtgaaacggcgatggatgcgtatctgattgacgataagcgtaagctgcatgtttgtggtaacaatccgaactgtgaaggctttatcgttgaagaaggcgagttcaaagtcaaaggctatgaaggcccaaccgtcgagtgtgataaatgtggctcagacatggtgctgaaaaatggccgctttggtaagtacatgggttgtaccaacgatgcttgtaaaaatacgcgtaagatcctgaaaaatggcgaagttgcgccaccgaaagaagagccagtgcatttccctgaactgccttgtgaaaattcggatgcgtattttgtgctgcgtgatggtgcatctggcttgttctttgcggcgagcaatttccctaaatcgcgtgaaacgcgcgcgcctttggtggaagagttgaaacgttttgctgagcgtttgccagaaaaataccagtatctgacttctgcacccgcacatgaccctgatggcttacctgctgtggtgcgcttctctcgtaaagagaaagagcattacgtgcggaccgagacagagggtaaaccttccggttggatggcggtttaccaagagggtaaatggttggtcacggataaacgcaaaaacgcgaaataatccggctcatcctttgttcaatcaaaataagacaaggcagcctcgctgccttgtcttatttttgtatcaggctttgcgaagcagttctgagaaataccagattggtattgatgcttttcatcatcaatttgccagagtgtgactcacgaaagagtcttacactttgatcctgcctactatgagattaaccactcaatctgagtccttttagcgagttctggcgttaccttctcgcaaactttgcgccccagaacccaacgctctttctcagtccgatatttatccactacgtattcttttctatgtattgagcgattttcttcgctaaatcatcattttcattatttaggaggtgagctgacattcaggcagttaatgtgccgtgatggctgaatatgaggtttatgtcattgaaccaccaaaagagtgtgagttggaataagtcttttccatctcgtcttgtttcaccactgagattttaagaaattgattggtattcggccaaggattcgataacgtatagccaaccgattgcattgtttattcagcacatttgtgctggctgtcgtactgatgttgctgtcggttagcatggagcgccgagccaggacccccaaagcaaaaatttcgtggttcggcaaatattataaaagaatggagaacaacacatggctggagtattaggcatgattttggcgggaggagaagggtcacgtttgaagccgttgactgaaacccgtaccaagccggcagttccttttggtggaagctaccgtttaatcgactttgcactcaataatttcgtgaatgccgatttaatgcggatttatgttctgacgcagttcaaatcgcaatcgctatacattcatatgaaaaagggctggaatctttccgggatcaccgaccgttttatcgacattattccagcacagatgcgtgatggaaaacgttggtatgaaggcactgccgatgcgatttatcaaaacctccgttttgttgagatcgtcgcgccggatcaagtctgtatttttggttcagaccatatctacaagatggatattcgccaaatgctcgattttcatcgccgtatggaagcggagttgaccgtttctgcactgcgtatgccgatcagccaagcctctcagttcggggtgattgaagtggatgaaaacggcaaaatggtcggttttgaagagaaaccgagcaatcccaaatcgatccccggtgagcctgagtgggcactggtctcgatgggtaactacatcttcgaagcggaaacgctcagcaaagaactgcgtgaagatgctgaaaataaccagtccagccatgactttggcaaagacattattccgaaaatgttcccgcgcggtaaagtctatgtgtatgacttcacgaccaacaaaattaagggagagaaggaatcgacctactggcgtgatgtcggaaccatcgaatcgtattggtcggcacatatggacttgctcgacaaagatccagaattttcgctatacaaccgtagttggccgctgcacacctactatcctcctttgccacctgcgacgtttgtggatgtcaaagacaagaaagtcaaaatcacagatagcttgatctctgggggaagttatatccaaggatcaaccatttataaatcagttctgggtttccgtagcaacattgctgctggctcttttatcagtgaatctgttatcttgggcgacgtgaaaattggagctggctgcacgattaagcgcgccattatcgataaagatgtcgagatcgccgccggtaccatcattggtgaagatttggaaatggacagaaagcgtttccacgtttccgatgaagggattgtggtgattgcgaaaggtagtaaggtaggattctagaatggaacaattcaacgtttggtttaccgtttcagaagtacaggggctggtaaaaagtggtggcctggccgatgtggcaaaagcgctgccacaagcgttgaaagcgttgcatcagcaggtagccattgcgctgcctgcttatcgttcagtaccgggaaaggaagacgcagagttagtactggaaacagagctgacacactggccgcacacgcagtatcgtgttttaaaacgcgatctagacggtgtgccaatctatctaattgattgccctgcttattttgaccgcccggcgctgtatgctgagaataatcaagcctatgccgataatggtgaacggtttggttttttctctgcagcgtgtttggacgtactgccgaaactcggtattcagcctgacatcattcatgcgaatgattggcacacaggcttagtgccttttttgttgaaaacccgttatcgctatgacagcttttttgagcaagtcaaaagtgtgctgacggtgcataacgcgatttttaaagggatcttttcctaccatcagttagaagtcattcctgagctcaatttatcgggtatggaatttctgcaatacggtcacgatcatgtgagcatgctgcgggcggggatcgcttttgcggataaagtgaatgcggtgagtcctaattatgcggctgagcttttaacgcctcttggggctcacgggctggtggatgattttgtgcgccgagcgcgcgatttacacggtatcgtcaacggttgtgattacagcgagtggaatccaagaaccgaccactatctgccagcaacctacagcgatgagcctgagtcgatgcgcaaggggaaagcgctgtgtaaaacggcgctgcaggaagagttacacctgccggttaccgatgtacctctgtttggtatggtttgccgtttaacgcatcagaaaggctttcattacttgttgccgattttagagcagttcctgcgcaataacgttcaagtggttattgttggtactggtgagccggaagttgctgcgcggttgaataagatcgctcattatcatcgagccaagtttgcgtttgtcgaaacctacagtgagcgtttagcgcactgggttgaagcgggatcggatttcttcttaatgccttctgaatttgaagcctgtgggctcaatcagatttacagcatggcttatggcactctgcctattgttcgtgaagtgggtggcttgaaagatacggtgaacgattacgataaattcccggagcgcgcgacaggctttggttaccaagagcccacgccagaagctctattgatcacgatgcagcgggcactcttgttttatctgcagcagccagaagagatgctgaaagtgcaacaacgtgccatgcagcaaaacttcagttgggaagagtctgcccaagaatatatgaagatgtatcgactcgcgcgatttggctaacgatatcaccgtccgatttgaagcggcagcagtgttggctgccactccaagtcgtttgggtctatgaagcatctctcaggcaccgcaaggtgccttttttctgtttcactcaacagtttcttacaactggggggattctcttgactaagattatggtagtcttggcctgcgtaattaagaggtttcaatgtcttcccctatgactgccattgccgaaaaagtgctgtttcacaaaacttatcttcacccgacaagtcaggagtgggtggtgttcgttcatggtgcggggggcagctcatccatatggttcaagcagatcaaagcgtatcggcagcatttcaatttattgctgattgatttgcgcggccatgggaaatccaatcagttactcagagactggattgccaatcgctatacgtttaagactgtgacgctggatgtgctgaaagtgcttgatcacttgaaaatccagtcggcgcattttgtgggcatgtcgctgggtaccatcatagtgcgtaaccttgctgagcttgccacgcatcgggtcaattctatggtgcttggtggcgcggtcacacgacttaatgcgcgttcgcaagtgttggttaagctaggacatttgagtaagcacctcatcccgtacatgtggctgtatcgtttatttgcttacatagtgatgccgcagcgtagtcaaaaagagtctcgccatctgtttattcgtgaagcgcaaaagctctgtcagaaagaatttaaacgttggtttacgttaaccgctgaggtgaatccgctgatgcgttatttccgcgaccgtgaattgccgatcccaaccttatatttgatgggagagaaggactacatgttcatccatcctgtgaaagagatggtggcgctccacgcacaaagtgagctgtatgaaatcccaaactgcggtcatgtatgtaatgtcgagcagcctgagctgtttaatcagcgttctatcgagtttatccagcgccaaatccgttaatccctcactgagtggtttggctaaaaccacactgccagcaggcggaaaattgcccttcatgatgctccccacactctgggcattgccagcattcggcgggggggggattgagaaattctcggatgatttgctgcgctgcggtttgttgctccggtttctgtaaccaaagtgaaggggcgctgctggaatccatcgggatctcgccgcgcagcgcaaacagcatttctccacgcaactcacacgctatcccttgctgatgcaaaagctgcatcagcatgtgcgcttcaagcggatgagtggccgtgtagattttcattgtccttcctagcttacttttaccaagagtgacttacttcactggcgattgagtggcacgctgttgaaatttacccatgagccatttcaccactatcggaaatacgcctaacaaaacgaatgaagcgagcacagggagcgacacaatttcgcctaggcttgagatttccgccagttgagtacccgcattgagatacaccgccgtacccggcagcataccaagttggctgacccagtagtaacgccaagtggagataggcgttagccccatcactaagttaatcaggaaaaatggaaaaatcgggatcagtcgcagagagagtaaataaaacgcgccatctcgttcaataccttgattgatggtttgcaatttatcagcgaatttagcttgcacccaatctcgcaataagaagcggctactgagaaaggcgagagtggcaccaatggtactggcaaaagaagccagcagtaagctcaaccaaaagccaaatagggccgctcccaacaaagtcacgaccgttgcgccggggattgaaaatgcggttaggagaacatacaccacaaaatagatcagtgcggcttgcagcaaatgggcatcaatataattcgctaattcggcttgtttggctttcgcaacatccagtgtgaggtattggctaaactgcgtcaccaagagcgcggcaatggcaatcaaaacaatggcgatgatgagttttttatacattcgagtacctagtcattactttatggtttgtggggcgtgatattgcccgttttacttggctcttcagcggtgtgggctacgtttcttcacccaatcatagagtgtctctggtttgatgtgggtgcacacagtgaccgccgacgtgtcactccaagtcattagagtatcgctcattactcaagtatatcgtctgtaactgaatttactggagatacatagagagcctaaaagtaaagacaggccaaaggccgtttttctttcaaaaaaataacgcgccactttggacgcgttatgaaatatagggtgtgtaaaaacacaggatgattacaggcgttgatgaactcaaaatgaaactcagagatgccttaatagctcatcacgacgattttgtgggatcaccgaccaatgtttaccttcgattgcgccttctagagcccatagcaactctaaactcacctctgccgtgtgggttcgttgaaccgctttataagcttcgacagaaccaagagtctgaagagactcgacggtgtcgatacctgcttttttgagcattctttctgttgctaaacgcaagttaggaagatctttcaaacgatcaggtttcgcttgtgcttgagtttcacgttcggccttagcgacctccagtgctgcacgcacttcattgaggatagagtctggatgactccaacaatcttcaggtagagcgtagtacttagttacaacggggaagccacgttttttgtaaacataaggttcataaccttgctgtttatacttttcgattgtggcgtcatctgcacggatgtgcagcgtatcgttaaccacaagcgcaaacatagtttcgtcgacgaaaataccaaagccaccaaacattgaacgagatttaacacgtcctagctgctcaaagagccgcattgaatcttttaatactggtttatccatgctgttagtctcggagtattgttacatacgccaccaagtcaggtccgagaaaattagcaaaagcatgcattcatagtgtcaatgatgagtcaacaaagtgtatgcattttgccatcggtaaccccgctacctaccatgtcttctggtttaggccggaggctttgcgtcccactctttcgaatggtttgccctgtgcgtgacatttttcctgataaaaattaatcattcttgggtcattctcacatactgatatttcaaatgtgagaatgagccctactaataatactcgcactacatatgttttgtcatatttatgtgacaagctttcaaatataggcgttatgaattgtcaagaaagttaggattttgtcaagtctttcaccgtgtcgcgctctacgatctctgggtgcatttcgaaaattcggcgctcgtgttctttgtctttaatgcgttctagcaaaatttcaaacgcgttcttacccacacgacgcttaggttggtgcactgtggtcagtggtggagagaagtattctgctaactcgatattatcgtaaccgatgacagacatatcttctggaatacgtatgcctttctgttgcaaacggctcatcaaacctaatgccatcgtatcgttgaaacagaataccgccgtggggcgcttgtccatcgcaatgattttatccgccgctaaaacggcagtatcacactcaaagttaccttccaagatccaatcttcattgacggtcaacttggcctccgccatcgcgcgacggaaaccttgaatgcgctcttggcatgcggctttgacgaagtgaccactcaaacatgcaatctcagtgtgaccgcggtcggtgagatatttggtcgcgaggtagccgccttcttcggagttatcgatgattttatcggcgtgcgacgtttctggaccccaatccataaccacttttggaatatctttgtgtgcatccaacatatcttgcagctcttgggtcaggtctgagcacatcaccaaaatgccatcaacccgtttttcggccagcatgcggatataatcgcgttgcttttcatagatgccgcctgtgttacataggatcagcgtatagccttgacggtaacagtagctttccacaccgtcgataacttccgagaaaaacaggttagtagattgcgtcactaacataccaatcgtgcgagtggtattgcactttaagctgcgtgccacggcacttggcgcgtagttcagctgcttaacggcttccatcactttctcttgggtggtttctgccacaaagcgagttttattgatgacgtgagaaacggtagtggttgacacgcccgcaaggcgcgccacatctttaatcgtagccatagagtgttcctgtcgatgactgctgccagcgaataacatcggtggatttaatcagcagaagtaaggcgagactgagcgaatcttcacactctgtgcgagcacatgtccaacactatgccgtacgtaaagcgcttcaatcactatgcctaaagtaataaacctaaagtaataaaaaacaaaaaccgccgagaaacagcggttgaaatttttactcgtttttatcgtttgcggatggattttagactgcaaatctctccgtcgcaacgaaattcattcaccaaactataagccatttcacaattaattcgtctatccccttcctatttgaccctgccgtggtgttggctaccacacgaagctgtttgggatagataaaataggctggctttccgctttgcctgtctggctaatgggtctcttggaacagctcatcaagacagtgtttatcttgctgaataaaggctaacgctaaacgagcggcggctgagtacaatccgaaagcatcaaattgagtgcaacgttcagcaaaggcaggtagccaagtgagtaagtgttgacttatgaagtcggactgagcttggagcgctgaactcagttgtgctgagtgctcaatttggttagcactgatggcaagatgcgctaaaaaatcgagctggatggcaagatgatcctcgggctcattgagattttgttcaaccttaaccccatgtgcgccgagtaactcacgcatttgctgagcaggcttgccattgagtaaacctttatcggtatagacagaagcatagggcagggcggaatcacggtctgatttcaaaaagagatcacagaaatctgcagcgagctctagctgcgcatcttggcgattttgtaagcgattgagcgcctcgaccaaatgtttaacttcgcgattcaggctttgctcatcagcgagcccgcttaaaaaagtacgaacttctgctgagtgatagcgagcaatatcttgctcgctcagttctttaaaaaacaggctcgacagccaccaatagatttcagcacgcttttcattgaggattttcagttcttgcatcatctttgcactcccaatcgatgtgtgcttagtctaaaccataaaaatgaacagctatcacggtgattgtgacagtttgtgaaaagaaaagaataggttgttaatctgttaaaagaagtttgctttgcatcaagaaaaagtgaggtttctcacgatttttctcgagttattaacaaatatgaatagaataaccctgcgatacatccagttatttaaaatggtgcattatgagctatcacgtacttgtggttgaagatgacctcgtcacgcgaagtaagttaagtggttactttcaaaatgaaggttaccaagtgacggaagcagaaagtggcgcacagatgagagaagcgttagagctcaatgacatcgatctggttttgctggacattaatttgcccggtgaagacggtctgttattgacgcgagaattacgcagccagtcggagattggcattattttagtgacaggacgcaccgacagtatcgacaaaatcgttggcctcgaaatgggcgcggacgattatgtcacaaaacctgttgacctacgcgagcttcaggttcgtgtaaaaaacttattatggcgaatttccctcgcacagcgagagagaattaccgacaaacacgatgacaaactggtgcattttggtgagtggacgttcgatgttcagcgccgtgcattaagccgtaatggtgagccagtcaagctcactaaagcggaatacgagttgttggttgcgctttcttcttatcctaatcaagtgctgagccgtgagcggattttgaacatgatcagtcaccgtgtggatgcgccaaacgaccgtacgattgacgtattgatccgccgtatgcgcgccaaaatggaaatggatccgaaaaacccgcaaatctttgtgacggttcacggcgaagggtacatgttcgctggggattaaacactgagagtgtcctcatcgttttctgcattgtaaaaataaaaaactggctaaatgccagttttttaatgctacatatgatccctaaagcggatgaggctaaggtgcgcttggtgcctcttcaaccaccggtggagtaagcacaggctcaccgctatcccccgccacagtatctcgcagggtttgccacatcagtcctaaagtttcatgccaatactgctcagtttgctcaagatagcgcgatcttggaatgtatttatcccaaggctgaataatattgaggtggcctaagtaattggtcggggcaggaataggtgttaagcccgccgattcaaattcacgcatcgcacgcttcatgtggctggctgaggtgacgagcaccatgcgtttttgttgcacgaaagcggccgcttggcgcgcttcttcccaagtatctttagcggtttccagcaaaataatatccgatttaggcacgcctaacgccaaagcgacacgcgccatcatccgagcatggctaacttcgctgccgccagcgtaaccggagaggataagtttcgaacccggatacatacgactaatacgaatgccttctgttaagcgcatgagcgcagcacgagtaagctcggaggtggggggaatatcatcatctatgacatggccatttccgagcaccatcacgtagtcaagagtaccttctacgggtaaaaatgccgtgtaagtacgttcaagtggcatcaacaaacgagtcgccacgggttgaaaggaaaccagaaataacccagtgagggagaacaacactactaggcagccagttttacgttttgccgtgaacatgatcaacatcaggcccacgaaaccaatgatcagcagcgctggcagaggcatcaacagtgaagaaaatatttttttcagctcaaacatagagaaaacagtccgaaaaaacagcacttgattataaaaagagtcgaagcctctttattcctgccattcgtatgacagaatagcaggcacggttcgttatcataactcaagctactgtgacagaagatcgcaatttcgacgatattgcccacaaatttgcaaaaaatatatacggttctgacaaaggtgagatccgccaagtcattgtttgggaagatttggagcagcttctcagtcaactggacacgcaaaaagttcccttgcacgtgctcgatgcgggtggcggcttggcgcaagtatcgcaaaaaatcgctcgccttgggcatcgagtgacactctgtgatctttcttcggaaatgttgcaattggccgaacaggatattgcaaacaatggcctgcttgagcagtatcgcttcgtccattcaccagtgcagacgattcaagcacaccttgatgcgcccgtggatttggtgctgtttcatgcggtgatggaatggttagcggagcccaaaccggcgttgcaaaatttgttggcgcaagttagaccgggcggcatggtgtcggtgatgttttacaactatcacggtttggtttacaaaaacgccgtgtgtggcaacattccgcacgtgctagaggatatgccgcaccgcaaacggtttaaattacaaccgcagaaaggcttgctccccgaagaggtctaccaatggatcgaagaatcgagttttgagatctgcgggaaatccggtattcgttgtttcagtgattacatcggaaacatgaaaaacatgggcgaataccagtatgaggatttggtggcactggagcgcaaattctgccgtcaggagccttacctctcattaggccgatacatccacgtatgggctaagaaaaaacaataacaggacacacaatgagtgagtttactcaggatactgtgcaaaagcccatcgacgaactcgtcacttgggtaaaacagtatgacttctcattgaatctgcctactgagcggctggcatttttgctcgcgattgctgtgctcagtaatgaaagatttgatgaagagctcggagaaggggaacttcacgatgcattcgcgatagtcacgcgcttgtttgcagaatcgggagaagcctcagcctttcgggctaacaatgcgattaatgatctggtcaaacagcgcttactaagccgctttaccagcgaaatgacggaaggtgccagcatctaccgtttgacccctttagcgatcggcattaccgattactatgttcgtcatcgcgaattttccaaactgaaactatccatccaactctctatggtcgcggatgagatggcgaaagccgtggaatcggcgcagcagggtggcagtgtcgcccattggcgcaaaaacgtgtttggcgtgctcaaatattcggtgagtgaaatcttcgatcgcatcgaccttaaccagcgtgtgatggatgagcagcagcaatcggtcaaagagcagattgcggatctgctgaataaagattggcgcgatgcgatcaacaactgtgaagccttgctgtctgagacttccgccacactgcgtgagctgcaagataccttgcaagcggcaggcgatgagttgcaaacgcaaatcctcgatattcaggagtgcgtgtatggcgatctggaattggatttcatcgaagagacgctgtctgcgctgcaaatgaagctcgaccgcattacgagctggggtcagcagtcgattgatctttggattggttacgatcgccacgtccacaagtttattcgtaccgcgattgatatggaccagaaccgcgcgttcagccaacgtctgcgtcagtcaatgaacgactattttgaacaaccttggtatctcacttacgccgatgcagaacgtctatccgatctgcgtgatgaaaccttgaccctgcgtgacgaagaagttaccggtcatgtgccgacagaagtggaatacgaagagctgcaacaagtgaacgatgaacttgcgcagcggattggcgacatgctgaaagtgcataaagagcagggcgcagcaattgatttagcacttgtgctgcgtgattacctagctagccatccacgaacccatcatttcgatttagcccgaatggttgtcgaccaagcggtaagactgggttactccgagtccgactaccgcgctatccagcctgactggacggcgatcaacgattttggcgcaaaggtacaagcgaatgtcatcgaccgatattaatgaatacatgccagagaatctggccaaagcgattgctaacccgctatttccagcgctagacagtttgctgcgcgcggggcgtcatgtctccagtgacgatttggataaccacgccttcctgtcggattttgaaccggatttggcgctgttttatcaacgctaccacactgagctagtacgcgcgccggaaggcttcttctatctgcgtcctcgttccacttctcttatcaaccgcagtgtgctctctgagctggatatgctggtgggtaaagtgctctgcttcctctatctgagtcctgagcgtttagcgcatgaaggcattttcaccaaccaagagctgtacgatgagctgttgaccttggtggaagagaagaagctgatgaagctggtgaccaaccgtgccagcggctcggatctggatcgcgagaagctgtttgaaaaagtgcgtacttcgctgcgtcgtttacgtcgcctcggtatggtgatcaccattggtgatacgggcaaattccgcatcactgaagcggtatttcgttttggtgcagatgtgcgtttgggcggtgatgtgcgtgaagcgcagctgcgcctaatccgtgatggtgaagccgtggtacataccccagaaccaagccagcaaagcctgttggaaaacccaacagctgagtacgacgaagagcaaaccgagtgggaagatgaagcatgattgaacgaggtaaatatcaatcgctaaccatgatcaactggaacggcttctttgcgcgtacctttgacattgataatttagtgaccactttatccggtggtaacggtgccggtaagtctaccaccatggcagcgtttatcaccgctttgatcccagaccaaagcctgctccattttcgtaacaccaccgaagcgggaagctcgcaagcgtctcgcgataaaggtttgtacggtaagttgcaagcgggggcgtgttacgccgcgttagatgtggtgaactcacgtaaccaacgtttactgtttgcggtgaagctgcaacaagtggcggggcgtgataagaaagtggatatcaaacctttcttgatccaaggtttgccaagtcatgttaaaccgaccgatgtgttggtcgaaaccgtgtccgacaaacacgcgcgtgttcgccaaatcaatgaagtgaaagatgccgtgggtcaaattgaaggcgcgcatttcaaatctttcccgtcgattgtcgactaccacgcgcagatgtttgaatttggcgtgatcccgaaaaaactgcgtaacagttcagaccgttcaaaattctaccgtttgattgaggcttcgctttacggcggcatttccagtgcaatcacccgctcactgcgtgattatctgctgccacaaaatggcggcgtgaagaaagcgttccaagatatggaatccgcgctgcgtgaaaaccgcatgacgctggaggcgatcaagaccacgcaagcggatcgcgatctgttcaaacacctgatcaccgaatcgaccaattatgtggctgcggactacatgcgccatgccaatgatcgccgtaacaaagtgggacaaactttggttctgcgcggtgagctgttctcttctcgtgaaaccctgattgaacaaaacagcttgctgaaccgtgttcatgaagagttagaactgctggttgagcaagagtcggcgctggagcaagattaccaaggcgcgtctgaccacctgcaattggtgcaaaatgcgctgcgtcagcaggaaaaaattgaacgctatcaagaagatctcgaagagctgaatttccgcctcgaagagcagatgatggtggtcgaagaagccaatgaacgagtgatgcaggctgaagagcgtgcgatcattagcgaagaggaagtcgatagcctcaaatcgcaattggccgattatcagcaagcccttgatgtgcagcagacccgtgctctgcaataccaacaagcggtgcaagcgctcgataaagcgcgtcgcttgctggataagtcagaactcactgcggaaagtgcgcaagcgttagcaactcaactgaaagcggagcaggaaacgcgcaccagtgaattgttggcactcaaacacaagctggatatgtcttcggccgcggcgcagcagttcaaccatgcgtttgaattggtgaaacgcgtgttgggtgaggtcgcgcgcagtgaagctgcgaagcaagcgcagcaagtgatccgtcaagcgcgtgaagctcagaatgtggtgcaaaatgaagcgcagtggcaagcacaacaacgtgatcttgagcgccaacttgagcagcaacgcagcgtgcgtgagctggcaacccaataccacaagcaacatagggtggtcttggatgatgccgcgaccgtcgagttagagcgtgagcgccactctgcactgctagaagagctggaaaccgagcaggaaaactgccgcgaacagcgtggtcagctgcgccatcaagagcaagaactgcaaacgcaaatcgcccgttttgagtcaattgcgccagcatggatcaaagctaacgatgcgttagaaacgctacgcgagcaaagtggtgccgaactggcggatagtcagtctgtcatggcgcacatgcagcaagtgttggagctggaaaaagcccaatccatggcgaaagataaactcgccgagcgtcgcacgaaactcgatagcgaaattgagcgtttagcgtctccgggtggctctaacgatccgcgtctgaaaggtctggcggatacgctcggcggtgtgctgctgtctgaaatctatgacgacatcaccattgatgatgcgccgtatttcagtgcgatgtacggtcctgcgcgtcacgcgattgtggtgtcggatctctctggcattaaagaaaaactggttgaactggatgactgtccggaagatctctacctcatcgaaggcgatgtggatgcgtttgatgacagctcattcaatgctgaagagctggaaggcgcggtgtgcgttcagcttaaccagcgtcaaatgcgctactcgcgctttccagccattccactgtttggccgtgcggcgcgtgagcagcgtttagagctgctacgtgaagagcgtgatgacgtggttgagcaacacgccaaagcttcgttcgattcgcaaaagctgcaacgtctgtacgccagcttcaaccagtttgtggcgatgcatttgcaagtggcgtttgatgctgaccctgaacaagccttggcgactgcgcgcgataagcgtaatcaactgctgcgctccatcagcgaatttgaagcgcaagagcagcaactgcgtagccagttgcaagcgagcaagcaagcgctagctgcgctagacaaactcgcgccgcaaatgggtctacttgacgaagagacgctcgaagctcgttatcacgagcttgaagagaaactgcaacagctgagtgaggccaaagcctttatcgctgcccatggccgcaccatcagcgagctggaaaaagtggcggcggtactcgatgccgacccagagcagtttgatgcactggagcagcaataccagcaagcggaccaagcactgcagcaactcaaagcgcaaatttttgcactgtcggatctgcttgaacgtcgtcatcactttgcttattccgactcggtggatctgcttaaccaaagcagtgagctgagtgaacagctcaaagcaaaattggtgcaggcggaaagtgaacgtacccgcagtcgtgaagagctgaaacaggcgcaagctcagctcagccaatacaatcagctgttggcgtcactgaaaagttcgcaccaagctaagctagaaacggtgcaagagttcaaacaagagctgcaagagtttggtgtgcatgctgacgaaggtgcgattgagcgtgctcagcgtcgccgcgatgagctgcaagagcgtctgcacacttcacgcagccgtaagagtgaatacgaacgcaccatcacatctactgagctggaaatgaaagcgctggtcaagcgcatgaagaaagtcgagaaagattatcaagacctgcgcactttcgtggtgaacgcgaaagcgggttggtgctcagtcttgcgtcttgcgcgccaaaatgatgttgaacgtcgtctgcacaagcgtgagctggcttacctgtcggctgatgaactgcgttcaatgtcggataaatccttgggcgcgctacgtctcgcggtcgctaacaatgaagatctgcgtgatgcactgcgtcagtcggaagataactcacgccctgagcgtaaagtgctgttctacattgccgtgtatcagcatctgcgtgagcgcattcgtcaagacatcattcgcactgacgatccggtcgaagcgattgaagagatggaagtggaactggctcgtttgaccgaagagttgactcagcgtgaacagcgtttggcgatcagttcggattcggtagccagcatcatccgcaaaaccattcagcgtgagcaaaaccgaattcgcatgctcaaccaaggactgtcgaatatctcctttggtcaggtgaatggcgtgcgtctgaatgtgaaagtgcgtgagagccatgaaatccttttagcaggattgtctgagcagcaagcgcaacacaaagatctgtttgaaagtgcgcgttacaccttctcagaagcgatggcgaagctgttccaacgtgtgaacccacacatcgacatgggtcaacgttcaccgcaagtgctgggtgaagagctgctggattaccgtaactacctagagctgagtgtggaagtcaaccgtggttcggatggttggctgcaagcggaatcgggcgcattgtcgactggtgaagcgatcggtaccggtcagtcaatcctgctgatggtggtgcagagctgggaagaagagtcgcgtcgtctgcgcagtaaagatattgtgccgtgtcgcctgttgttcctcgatgaagccgcgcgtctggatgctaaatccatcgccaccttgtttgagctgtgtgagcgtctggatatgcagttactgattgcagcgccagagaacatcagcccagagaagggcaccacttacaaactggtacgtaaagtgtttaaagatcacgaacacgtacatgtggtagggttacgcggctttgcgcaaaccgaaaagccaaaaaccgctgagcagaagttcgccgaagaacttgcaggtgagttgacggaatagttgagacccatcagggcttgatatgaaaacgcctttcaaatggaaggcgctttttttttgcagctgtgcttgttggtgagtttactgtcgctcatctttgggtgaatccatcaccaccatggtagtaatggatttcactaccgcacattcgccgagtacatcagcatggaagcgtttataagccaccagatctttggtttccacgcgcagcaagtattcgttcatgccggtgatgttgtggcattccacgacttctttagcaaagcggacatgctgctcaaagctgagctgtgattgcttggtatggctgtttaagccaatcgccacatacgcgataaaaccgacctcaagctggtttttatccaataccgcgcgatagcctttgataattttcttacgctctaaatcttgcactcgacgcagggtggcggagggcgataaccccacgcgctcggccaactccacattggaaactcggccatcgagttgcagctcttgcaatattctttcgtcaaacctatccatgattctcttttgttgtgcattcagtgttttgttcgctcatataaacacaaaattgcgtcagggagcgattaatatttttgcatctgacattaatcgagaacatcgttatggattacaccttatttgggccgctgttggcgtttgcttttgtttctactttttcgccgggccctaacaacatcatgctaatgacatcgggagccaatgttggctttctgcgcaccatcccacacatgttggggattacgtttggttttagcatcatggtgttgctggtgggagtgggtttgacggaattgtttcagcgttatccgatccttcaacaagggttacaaattctctgtactttgtatttggtgtatctggcagtcaaaattgctctgagccgaccatccaaagaggggcaagagtatcagccgatgtcttttgtggcggcggcgctgtttcagtgggtgaatccaaaaggttggtcaatggcgctcacggcggtgagtgtatttaacccgaatgcgagctggctgcagctcggtttgattgcgttggtgtttgcgttagtgaatttaccttcagtcagtgcgtggactgccgcaggcaagcaactgagttactggatgaatcatcccaattatgtgcgttggtttaatggggcgatgggaggattgttactgctttcggtggtaccgatgctttgaggtaaaacattcagcctcccaaatgggaggctgaaataggtatagatttaacgtgcgcgttgcggctgacgttgagtattaccacggctggcaggacgaccagagccttgtggtttaccgcctgtcgctgaaccccgttgaccttgttggcctcggttttgttcactgcgagcagattggttgcccgcaggcttgttcgccgttggcttactgcctgtcggtttactgccggcaggtttgccctgattggatttattaccgctgttcggacgaccttgcccgccagatttgttaccacgcagcgcatcaaagcccggttggctatgcgtatgcttggtcgcaaaacgattcgcgccatgacgacctgatttgcggctttgtgctggggtgactaggtctgaatctttttctgggatcagacactcagggcgatcaccaatcagatgacgtttgcccatcgcaatcagtgcttcacgaatcatcggccagttggcaggatcatggtagcgcagcagggctttatgcaagcgacgttgagcttcacctttcgccactggcaccttttccggtttcttgtatttcacgcgtttcagcgggttcacttctgcgtgatacatcgcagtagcattacacattggcgatgggtagaagttctgtacttggtcacaacggtagttgttggattttagccacagcgcgaggttgaccatgtcttcatcttcagtccccgggtgagcggcaatgaagtaagggatcagatactgttttttgcccgcttcagcgctgtatttttcaaacaactctttaaagcgatcataagtacccatgcctggtttcatcatcatgctcagtgggcctttttccgtatgctcaggagcaatcttcaaatagccgccgacgtggtgggtcaccagttcacgcacgtactcaggtgattcaatcgccaagtcgtaacgtacgccagaagcgatcactactttcttaatgccatccacatcacgcgctgcacgatacagatcgatagtgtgtttatggtcggtattcagcttatgacagatacccgggaacacacagcttgggcgacgacagttcgcttccgctttcggatctgaacagccgaggcggtacatgttcgctgtcgggccacccaagtccgaaatcacaccggtgaagcccggcactttgtcacggatttctttcagttcattgatgatcgactcttgtgaacggttctggatgatgcgtccttcgtgctcagtgatagaacagaatgaacagccaccaaaacagccacgcatgatgttgaccgaggttttgatcatgtcatacgccggaattttcgcatcgccatatttagggtgcggtacacgggcgtagtaaaggccaaacacgaaatccatctcttcagtcgtgagcgggatcggtgcttggttaacccacagttcacggtcaccatgacgctgcaccagcgcacggcctgaataagggttggtttctaaatgcaacacacggctggcgtgcgcgtacaaaatacggtcattaaccagcttttcaaatgaaggcagacgcaccgcggtggttttcgcatcatggcgtgatgggcgaatggtgataggttgagcttcttctttctcatcacctttggtcgcgcactgggtttccacttcatacggattgcttggcacaaacggtttgtttggctgatcaatgcgggtggaatcgataatcttaaaatgttcaggtacttgagccaaattgacagccgtaccgcgaatatcaaccatcttattaattgattcgccattggctaaacggtgagctacttcaaccagtgcgcgctcggcgttaccgaatagcaaaatatcggctttggcatccagcaggatagagcggcgaactttgtctgaccagtaatcgtaatgcgcgacacgacgcaggctggcttcaataccaccaagcacaatcggcacatctttgtaggcttcacgacaacgttgtgagtaaaccaatgaacagcgatcaggacgcatgccgcctttattgtttggggtgtacgcatcgtcgtgacgaatttttttatccgccgtgtagcggttgatcattgagtccatgttaccggcggttacaccgaaaaacaggttcggtttgccaagcgtcataaaggcgtctttagtttgccattctggctgcgcaatgatcccaactcggaaaccttgtgcttcaagtaagcggccgatgattgccataccaaagcttgggtgatcaacataagcatcgccggtcacgataatcacatcacagctatcccagcctaattgatccatttcttcacgactggtcggtaagaatggcgctgtgccgaaacactcggcccagtattttttgtagtggtggataggggtaacttcgctgtgcatattttggcctcaagattaagagggcggcattatagcggcttgcaaggccagtatctaccgtaacattgccccgattttgttaagggattatttcactcttacttgcgaaataatccacgaaaggaatcaaggcctaaaagaaaagtaggcaagttagtgtttagttactaatactttagttagggataagttaacgttatgcgtcagagttcattgtatggggtgacaagctgttctaaggtggtcacagaatcaacatcatcagtttagggataccggatgagtgtgaatgtatcaaccgtacaaccacaaagtatcggcttaaaaactcgttatgcaccactcgattggtgttaccagttagccagtcagcacatggattacgatattgtgatgtggcaatcactggtgggaaattctcgctcgattaccaagcccgacgattttcttgagtacttgcctttgactcagcgcgagcatgccgcgggctttttcgtgcaagcagatttggcgccacagagtctcaataccttattggtgagcgccgaaaagctggtggccttagtcgcgttttcggttgacgaagtgagtagccagcttgttcgagggacgattacgccattactgattttccattctggtatggaatccgcctttgcctttgatgctttatttgataatgaccatcatggagttgtgattaccgatgatcaaacgcgaattttggcgtgcaatcgttattttgagcagcaaacgggatatcaacaaaatgagctactggggttaaaaaccagtatgttcaattcgggcaaacattcgcagcatttctatgtggatatgtggcagcaattgcgtgagcaaggcggctggagcggcacgattttatctcagcgcgcttctggtgaagtctggccacaagacctatctattaaacgtttaagtcctcagaaaggacagatcttttatatcggctttaccacggatctggcaccgcatttggatcgcgtactggataagcaagcgggcgatgtcgaattgctgacacaattaccgacgctgtctaaattcagtgatcagttgaaacagcgtttacctaagcagcaaaccaccactggatttgtgttggcgatacagcctaaattcagcagcgataaatactatgcgcagatccgccggctggctgccagtttggcgcagaaccggcaagtgcaactgtgtggttatcacggtgaagggatttttctgtgtcagttggatgcggagaaaaacctagaagctcagcctttggtagggttacagcgcactttacgccagttttttattgagttgcgacaacgaggtgggcaggaagctcatcaagccgttgctaaggggcgtttaggggtttcggtgttaaatgtggataccgataaaatagagcgcctcgttccccatgccatccaagccatgttggagcaccacgcgggggaaactcgacatatcaacttttatgatcgcgcaatccatcagcagattgagcgtcgtaaaacactggaaaaatgggtgcagaaatggatagcaaatggcgatgtcgaagtgttttatcagcccattgtggatagccagagttggtctgtggtgaagtttgaggcgctgtgccgttttcaagctcctgagcttttacatgcatcaacgcaagagttaatttcgatagccgaagatctggggctgatcaatcagttggatgagttgattggcggtaaagccttaaaggatctgcctaaaattcacgctttatttggtcaccatgtgggagtcagcatcaatcgttcgttaaacagcgacttgagtgctgagcagattttacaaagcgtggttgacatgctcgctgaaacgccgactttggcgaaaaatatcacggtggagttaacggaaacggcttactttgactctcaatcacagggaggcgaagtgctgcagcatttacgaaatcgtggagtcactgttgcgattgatgattttggaacgggcttttcttcgttctcttacctcacggagtgtcagtttgattatttgaaaatcgatagagagtttgtgaccaatatcgaagtggggtcacgccgctacgccatcgtaaaaatggtgaccgatcttgcccatactttgggtgttaaggttgtcgccgaaggagtagagactgaacatgaagtgtatgtcctcaagtcgctgggggtagatctattacagggattctttttcgccaagcctttgccactgagtaaccttattcatgcctcggattatcgtaaacatcttaagctgaccaaccgtgaatccgataagcaatcacgcgaaattacaacactgcaaagtttagcgattttcactcaatatcggctcgaccccggagatccactctcgttggcggtggaatactttaacgcggtgcagtccgatgttttaccggttgttacggctggagaatgtgtcggcttggtggatagagccgcgctgaatttacacctcacgccgacgatgggcaccgaattggaaacggcacgtgaagccgctatttggcgcaaacccgtcaatcaaatcatgcgcacgccgcaagtcaaactggctcatgatacagacctcaagctattagcctcgttgctcaaaactaatccaccgccaccttgggttttagtcgagggtaataaatacaaagggattgtgactgcgccgcgtctgctcgcttatttagcgagttgatacagtcagcaaggctgagaggaaatatcggttctccaaaacgccactcataaaaaagcccgcttggcgggcttggtttaggttgaataatgagtgttgtacgaattattgattcgatgagtgcgctcagcgcttagcctttaggattagccttaggtgtcatgatcagctcttgtgacatagtatctttgccaaataacgtttgagcacgttggttgatgtcatccagagtgatggatttcgtcagctcctcaaccttgtagatggtctcaacgccatagtgatgaatcgcataacgcaacatgaagtaagcttgctgctccggtgatttgttgagcggtttcatatcaatcaagaacttctgtttcaccacatccaactcttgctgtgtgacaccttgagccagctcacgcgcgacctcatgcatcactttggccacttgtggttcacttttggggtcgactaaagctgacaatacccaatcattgagaatgtctccatcgaccacgtatgggatcacttgtggcgtgtagtctaaaccttgatgctcgcgaacttcagccagtaaacgctgagtcgcaatacgctgcaacatatcatcgataaagacggtttttgcggtacgcggctgcgtttcagatatcaggcgcagggaatactgggtcgagttttcattgttaagtgctaactctaagcgtggcgcaaccggtttgatcaactggctggtcataggggaaagcgttcccttgctcaaaggtatacttgctacgtactgacgcaacatcggggttatttgagaccgctcaatatcaccgacgatgaccagcgtattattgcgtccttcactgaagagacgctgatgaacctgctcaatttgctgtgccgtgacttgagcaatctgctctggagtacgaattctgtagggacttgtttcgataaagctttggttggtcaccgtacggaagaaagcgccaataggggaatcaaagtacgcactacgattttgagtaaattcggttttcactgaattgagctgatcagggctgactttgacttgagttgacaataaatggagtatttccaacagctcaggtaactcttgcgctttactattggcttcgaaaccatgactggtcgatgcaatatagctatagaaaccaatgtctttctgacgaaggtagcgatcaaactgagagccgttcaacgtatcgaggccacttcgtgtctgtactgcagtagcaatctcggctgcagggagtaggtctgcaggtaacgcgaattggccacccgaactggcgtattgaacaaagacgcgatctttggcttcaatattgcgcagataatagacatcaataccgttatcaagctgccaataagtcacctgtggatcgtcattgatatcgagttgtttcaccacttcgcccgcagtaaattgctgggtgaatgggctatcgatttgttgatcgataggctgattgccaggttgcgctaggtcgttacgccattgtggcaaggctttgttcaacgcttgcgcatcttcagtggccgcaacgccaacaacccagacagggttttggctcaattgctgttggatatgacgattgatcatttctggtgtcgcggaagcaataaactcgctcaagctcgcttggtaatcgagcgtcgcttggatcggtgtatcaaacacaatcgagtagactttttgattggcatggctcgctggggtaatggcttcgcgatcttcttgcaaaaaggttaagtgctcacgataaccgcgcaaaatgatatccaactcatttttggtcaccccgtaatcacgcattgaagcgagggtttccagcaacaaggcttgcactttctctcgttgttcggccgcaaacccgacgctaatgagagtgtaacgttgaccttcgatttcataatgggttgcgtaaatgccggttatggcctgcgctgcatcattgaatgccgctactaggcgtgtgtgcaggagttgttcgccgacatcatcgcgccaaaactcttgctggctggcatagtctttaatcgctgctgagccttgggggaagatcaaggttaggctaggcgattcacctgcagtcaccggagcgactaggtcttggttattcagggcttggtgataaatcgaagctggcttttcggtggagcctttcttccatgaggagaaatagttctcaacccactgttggccttgttcaagggtaaagttaccagtaatgaccagttccgctaattgaggttgataccactgttggtagaaggctttcaaactgtctggagtggcggcttgcaccaactcgcgtgaaccgaggggatcgcgatccgcgtaggaggttccttggatctggtgcagataaaactgctgctctaagctcatgttttctgtgcgtgaggcgcgaaactcccccaaaatcacccctttctctttttcgacttcatcagcgtcaaacgctaaaccgtcagcaatatcagcaaaccacaatagcgctttatcgatattttgcgcattaggtaggtcgagctgataaaccgtgcggtcgtagccggttaaagcgttaaagtccgcaccaaactgggcaccactttgctcaaacatacgaatcacatcgttgtgctgataatggcgggttccgttaaacgccatatgttcgatgaagtgagcgtaacccgcttgctgcgcggtttcttgcattgaacctgcgtgaacgtacaaacgaatagagacttcttgttcactgtctgggtagagatggtaagtaaggccattgggcagtgtttgagtgacccagcgttggtcgggttggagtgcgcggttggtttgttgtaaggcgcaaccggcgaacagtatgcataaaatgctgactaataatcgaattttcatatcattctctagttatagtttgacggaaactataacgcattgtgatgttttgtcgcttcacttttgtttggcttgctgcacttttagccattttgcgatctggtctgagtagttcacaccaccggagtttcatccacagaggaaattcgcggccgccgcttggggttctcgaaggaggtttgctattatctgccacctcgacagctctctgatttggcaaactatgctttattctctgatttccgtattcgcacctatgttattgggcgcgcaaatcattttgacactggtgctggtcaagggggaaatttgccccggacagcgtggtcgtatccacaaagtattgcctgcgttagcggtgctctggttggctgtggcgtcgatcaaaattgaagcgtttctggtggtgtttgcgctgttttacttctattcgcaagtgcagactaaaaaaacgcgtgaggaaggcccgctttgggtgatgtatttagccaatggtttagcgctggcttacgtcgggattttgatcagcgaagcgccggcatggcctgcatcgctcactatctttgcggcaattttcctgctgggtgcgatgttaggacatttgctactgacactggctcgctcacgcttacaagcctttcatcgaatcttgcctgtggtagggattgtatctgccatgctcactgcgttatgccttttgccttatgtttctggtttgaatgacgagcaactgcaaacactattgatgccgattgtgatgagctttggcttattgattacgggtatcgtggcgtggtgctggcatttgatctctggcaaaaccgtcaataaatggcagttattgctcgcagggcttttggtactggcatccgcaaccggattccacggtttgtatcaaatgccgttgtagcgcagtggagtgaagtgcgtcgcacagatcacttttcgttacccaaatagcgactatgcttgatgaagttggggagcggaaacgctgagtgaaaacattcaatcaggagtgatgtgatggatctgagcaacgtacgaaacttcgatagcgtgatcttgctgggcatcgtcaatgaaaaactgcgtttggaatgtgacagcctggatgagttgatcagcacttatgaaatggatattgagcatctggtcggtaagttagacgtactgggttatcaatacgatcctcttaccaaccagttcaaagcttatgctcggtagtgatgcctaaagtgaagccatcttgatcccatcaaggtggcttttgcattgttggcgtgcggtagcgaaaaaggcttgcaggtagcgtttgtctttttcgctatggcgagtggcggcaaacaagcgacgccatagccctttacctaacggtttactggtgatgagcccttggcgtgaaaactcgctgattgcccaattgggtagtgccgcgacgcctaatcctgccgacaccatttgtaccagcatcaaggtattgtcggcttgcttccagcgtgcgggctcaacgcctgcgggttgcaaaaagtgcttcaccacatccaatctttgcttttgcaccggataggtgagcatggtttgatcggctaaatcttggggctcaataccggctttgtcagccaatggatggttggtggcggtgataaggcgcatttcaaaatcaaacagcggctcataatgcacttctgagcgtggcaaaatatccgaggtgatcaccagatccaattcccccgctaacagcgcgggtagaggttcaaacccaaagccggacgaaaaatccagcgccacatttggccagctgacctgatattcgcgcagggcgggcattagccattgaaagcaggagtggcactcaatcgccatgtgcaggcgtccattcacatcttctttaaggcttgccagttcattctcggcgcgcgacatcttaggcaaaatatcatccgccaaacgcagcaaaatttcgccttcggcggtaaaacgcactgggcgtgttttacgcaaaaaaagctgcccgccaattcgcgcttccaagtctttaatctgatgcgagagcgcagactgggtgagatgcaacgaggtcgcggtggcggtcagtgaaccggtatcgcgtagcgagatcagcgttttcaaatgtttcagctctatcatgaactctcctcacttatccctaagccaacatgaatttttagctaagttacgccgatttttcggagctgtaaacatctagatggctataaccttcctgcttgaagccgcagcggtgttggctacattcgttcaccccaatcacatagtgtctctatgctcatggggatgaactcacttgccgcctacctgcaactccaagcagtttggttataaatagtaaaggtaaattgataatagccagtgccaacatgaaaattactaataaacaagttgaataaatgaaccttgtcctcgaaggcgtacaacgcgatagtttagccatccagacatctttcgatgtgctgaggcagcttagagcttctacgacctattaagaacagacaaaggattttcacatgacaacgacacacattcttggttatccccgcattggcgaaaaacgcgaactaaaatttgctcttgaaaaatactggcgtggtgagattgaccaagcggctttgaaacaggtcggtagtcaaattcgccaaaaaaactgggcattgcaaaaagaagccggattagactttgtgaccgcgggtgactttgcttggtacgaccatgtactcaccaccacgctgttactcggccatgtgcctaagcgccatagccacggttttcctgatttagatactttgttccgtgtcggtcgcggtcagtcacaaaatgcttgtggttgtggaacgggtagcgcggcttctgatatgaccaagtggtttaacactaactatcactatatcgtgccggagttcagctctaacgacacgtttaatgtgagctggccacaactgtttgaagaggtgaatgaagcgctgcaagcgggtcacgatgtaaaacctgtgctgcttggcccaatcagttacctctatttaggcaaagaagtggaagagggttttgatcggttaacgttgttgccgcgtctattgaccgcttaccaagcgattctgagcaagctggcgaagcagggtgtgcaatgggtacaaatcgatgagcctattttggcgttagagctggaaccccgttggcaagaagcatttaaactggcttatcaggtgatccgcggtgacgtcaaactgctgctgaccacttactttgattcagtgttagatacgcttgataagatagtcgaactgcctgtcgatggtttgcatgtcgatatttcggccgctccagcgcagctcgaaactattgtgaaccgcttgccctccgattgggtgctttctgcgggggtcattaatggccgtaatgtttggcgtgccgatttgagtgccattctggctcgtctacaacctgtaaaaaccttgctgggtgagcgtttgtgggtcgccagttcctgttcactgctgcacagcccagtcgatctggatttggaaggcgatctcagcgcagaaacacgcagctggtttgcgtttgctaagcagaaagtgacggaagtggccttgctggggcgtgcattggaaggggatgctgcggcgattctggcttgtgatacctatagccagccaattgttgcgcgtaagtcttctcacatcgtgaacaaggcatcagtacaaacgcgcatcaacaatattactgctgcgttggcagagcgtagtgccccttacattgagcgtgctcatcaccaagcggaagtgttgggtctgcctttcttaccgaccacaaccatcggctctttcccacaaactggtgagatccgtactgagcgtagcgcgtatcgccaaggcaaactgagcgagcaagagtatgtgcaagccctgaaaggccatattgctgatgcggtgaaacgccaagaagcactagggctagatgtgctggtacacggtgaagcggaacgtaacgacatggtggaatactttgcagaaaacctcgccggtttccaaaccacgcagtttggttgggtgcagagttacggttcacgctgcgtaaaacctgcgattgtggtggcggatatcgaacgtgaaaaaccgatcacggtagagtggtcaacttacgcgcaatctctaacttctaagcagatgaaaggaatgttgacggggcctgtgaccattctatgctggaccttcccacgtgaagacatcagtcgccaagagattgctcagcaattagcgttggcactgcgtgatgaagtggcggatctgcaagatgcaggcatcaatattattcaaattgacgaacccgcgattcgtgaaggtttaccactgaaaaaacgcgatcatcaaacgtatttagattgggcagtgcaagcgtttaagatttcggcgggtagcgcgcgtccggaaacgcaaattcacacccatatgtgttacagcgaattcaacgagatcatcgaatcggttgcggcactggatgccgacgtgatcaccattgaaacatcgcgctccaacatggagctgctcaaagcgtttgaagagtttaactacccgaacgaaattggcccaggcgtgtacgatattcactcgcctaacattccagcgcaagcatggattgaagatctgcttcgcaaagcggcagaaaaaattccagcacagcgtttgtgggtcaacccagattgcggtctaaaaacccgtaactggccagaagtggaagcggcactgaccaacatggtcaacgcagcgaaagcactgcgcgcggaatggcaagcttgatatacgcttcctacttgaggtttacctacaacgccaagtagtttgagtaaaccgttagaaaccgcaaaggcctcttatgaggcctttgttcttttcgtttgtgttgttcgagagtcaatctggaatatccccttgctacttgaagctgcagcggtgttggctacgttcgttcatcccaatcacataatgtatctatgctcatggggatgaactcacttgctgactacctgccgcaccaatgagtttgggtatagctcgatgactgtaaactcgcttaaccttgcttgcagctctctttcgtgaccaactgatcggccattaattgaccacgcgtgttgcgcatttggatgcggtagctgatcccaacatccagattcgaacggatgtctttgttagcacagaagctgctgaccgcgctttgcagtacttgctcggtcggtttggcgttattggcatccgtgttgtacaccatcattagctcaacagtactgcctttggcggtagcacggagaatattcagtgggccaaactccaatggtaactcggtcgagagtaagctggcgcggttacccgccaatagctcaaggttacgctgtttttctgctgagccagagctgcaaccgacgagaaggagagtcgaggcgataacgctgctcaggacgatttttttcatatcagaatacttttttgaaaggtttaacaatgacgttggcataaacacccgccgcgacataaggatcggcatccgcccaagcttgtgcttcaactaaggaggcgaactccgcgatcacggttgagccagtaaagcctgcctgtcccggattttcggaatcgatggctggcatggggcctgcagtgagcagacggccttcatcttgcagttgttgtaaacgctccagatgttttgggcgcacgctcagacgtttttctaatgagttctcgacatcctgcgcaaaaatcacataccacataacactttaatccttatcaactgaccaaaagcaaagtcaatactctacgcaactcgcttgtgaaacacagcctatcaagatgatttctgtgatccattgctgaggcttattgctctggggcggccatttgcatcaatcgccacatagttaaaggtggcttcacacacttgaaaacgttcgccgaccccctcttctttgaccggcttaacccacacttcgagattgatcgacatcgatgtgcggccaatcttggtgcattcgccgtagcaacataccacgtcaccgactttgacaggttttttaaaagtgatactggaaacagaaacagtcacgatgcgtccacaggagatctctttagcgagaataccgcccgctaagtcgagttgagacatgatccagccgccaaaaatatcgccatttgcattcgtatcggcaggcattgcgagtgtgcgcagcagaagctggcctttaggtgaatttacggtttgattcatttggggatccacagcaaacaaaacagcgaccgaatacggtcgctgtggattaggggcggattataaccacaaattcgtcactggatcatccctttatacccagccaatctccttcctgcttgaagtgccaaatcgtttgggtatgccatcaggacaatttattggtttttctgtttgggttcatggggaaggtgtttgtagatgtagcctcccgtgagcagagtaaacactaaggttgccgccaacagaccaaataccttgaaattgacccagacatcaagcggtaggtggtaggcaacataaagattgagtgcagcgcagccgctgaaaaacatcacccatgcccagttaatggttgaccataccgcatccggcaaggtgagctctttaccgagcatccctttgatcgcaggcttacccatgatctggctgatggttagaccgagcgcaaaaaccacatacacaatcgtcactttccatttgatgaagttatcgtcatgcagggctaaggtcatgccaccaaacagagcaaccatcacgaatgtgatgagctgcattttctccacttttttgtacatagcataagtgacaatcacttgaaccgttgtggcggcgatcagcgcccctgttgctacgtagatgtcataaaacttatataaagcgaaaaaaatgatcagtggaataaagtcgagcagttgtttcattttgggtacgtccagtcaaatgagtggcgacagtgtagcgaaactctttggcaagaaaaactgttaagcgatgtttgggttctctacagaggcaagcgccggtcgcttaagccatgctcaaggctgtaatgatttgaagtcaggagggaggcggagataaacaaaggatggctttcgccatcctcatctgtcacacatgacgaagataagtgaacttgcctgagcaaccagactagttggagaagtcatgtaattcgtgaaggtagccttcgcttcttagggcttcaagggttgacgctaattcatcatcggacatggttaaacagctggatttacccgtcatgccatacaaggtctgctgataatcaagcgcagagtaatagcccatacgatcttccaacaattcacgcattcctatgtgaataaggtcgtagcagtggtgacgttgtaattccataatcaaactccttgattgctgtttggaaagtggaggcgaccccaacgttcatttttactcaaacagtcacttctattcaaaaagtagcatctacctaaaaaagtcactatctaaaaaagtcactatctaaaaaagtaacctatacccaaaaatagctaagcaaaaccgatgccacaatcatgacatttcaagattcacttttaatggcaacaaggcttgataggcctgcatcactggctctgggataggttgcgtgatttgaaaacccagcgctggataatctcggatgcgttcaaaatcgcccagcatggcattgagcacaaaatcactggtgagctctgaagttaaatagtcaaaaaaactgcctgcgggtgaggtaacctgcacactttcgaccgattctggccactgttgcataaatgtcgcataagcgcgacgttccatataaggtttttgcaccagtaagatgcgtttggcaggccgagcttgttgtaccaatagctgatggctgaaatgtagattttcaccactattggtcgattgtgtctcaagcaaaatcgcgtgttcagggacaccagcatctttggcgatcgctgcaaaagtctccgcctcattgtggttaaataccccttgagtaaaacggccaaagccaccagaaaacagtacataaggggcaaggccttggtggtagagttttgccgcatgttctgccacacggacatcgttactgccgagcaccaaaatcagatccgcaacgttgggttgttggtgcaactgcaagtaatcccaaagggtttcaatctgttgatacaagcgtttactcataaccgtgcacagcctctaaggtgtgagagaaatgaaaacggtaaccagctgccaataatttgtcgcacacaatccgtttctcctctttatcacacagcggtggcagaggcaggtcgcttgctactgcgtcgagtgcggcctgataaaactccgctttactgaccgtgttgggggttgtggcgttgataatcgagtaggggagctgctctagcgaaaaatgagcgataccaatcgcgtcatacagatgcagcatattggctggcgcgagtcggctgacttgtgccattttgctgacaaagcgtgatgggtggcgtttaggccccatcaggccactgcaacgcagaatggtgtaatccatacctgaggtgatcacatactgttcggctttgagtaagatgcgcgctttcgcatcaaaagcggaattatccagtgccaatgccaaagaggcgtcttgttcattcatcgctttggcgatatcgggatacacagaggttgaactgatcatcaccagtttttgaatattggcctgtttggcatgctgcaccaagttttgccaatgtttggcatagtgctcgccagcgccttgacgaaaaccgggaggaaagcagccaatgacggtatcgcattgccgctcaagcaaagcatcgcttaagccatcgggttgatctaattggcaaacaaaactctcaataccttgatcttcaagagtttgaacagcctgtggggtagtgcgtgtcgcatacacaatatggccttgttgcttaagccattgtgccagtggcaaacctagccatcctgcacctatcacgacaactcttttcatcagttcatcctttatctaagagcgaatgaggtggctaccgtaacacagttggaatcaaggaagaaaggcaatgagcgcagtaaagcgctcattcaaaacaggattacgcgttcagtacacgcagtacgcggtcagcgtgttcggcaatctcgatgccttcatcggtgaggtaaccaccatcaggttgagtacataagcctttgttatacagacgaaccacagcggcttgtaccgcttcagacgcatcgtggtgcactttgatgccagtcgctgcgctgctcaaatcaaattgcagcagtaaattaagctcatcgatgtgctgttgagtgaatttcatggctattacctttttaagctgttgttgcggcaacaataggctgcgcagcatcaacacgcaatcttgtgctcgcagaactgttagcttgacccgatctggtgtttttttcagcgcaagatgaggaaaatgttttgaacaacagcacaaaattcacggcgagaggagtgaaggttaaggtgaccaccgaacgcgaaagttgaggtgaatagacggagaaaaccgcgctgtgactccaagtaggacgggtatctaaacatttttcgtgaacatgacaaatagcccttgaactcaaggggaaatagagcgattatccgccacctcttctgttgtgtgtcaaaatgtaacaagctcatggaacataaccaattcgattctcttctcccaccccagatggcagaacgtgccgccattacgggtgaaggtaaagctaaaaaagcggcgtacaaatctttcctgttggcgatttctgctggcatccaaatcggtattgcctttgttttttataccgtagtcacgactggtgcccacgatatgccttacggggtgactaagctgctcggcggcttagcttttagcttaggtttaatcctagtcgtcattactggcggtgagctgtttaccagctcagtgttgattttggtggcgaaagcgagtggtaaaatttcgtggaaagagctggttcgcaactggacggtggtctacttcggtaacttatgtggctcgattatcttagtgtttatcatgctcgccacccgtcagtttatggaagatggtggtcagcttggcttaaatgcgatggcgatttcccagcacaaattgcatcacaccttcttgcaagctttcgcgcttggattgatgtgtaacatcctagtttgtttggcggtttggatgacctttagtgcccgctcgttaaccgataaagtgatggtcttgatcctgccggtggccatgtttgtctcttccggttttgagcactgtattgccaatatgttccaagtaccgatggcgattgggattaagtattttgcgccagagagtttttgggcaatgacaggagcgaatatcgctcagtacgcagatctcaactttgttaacttcatcgtcaataacctcattccagtgaccttaggcaatattgttggtggcggtgtgtttgttggcatgtggtattggctgatctatctaaaagattaatcctgacaaccatcagcgcctccccaataccccacaatccctgagtgttactcggggatttttttacctgtttttccttgcactcatggggttatcatcgtggtgcaatcgcttttcgacaccagtagccttatccacattttctgtggataactcagagcaaacgccgtgtgtaaccatatcgaattgaattctgtgaggaacggtgcgcatttcttgtgcaagctgcctacttttggggcgcagcaatgccaatatttccttctcacctgaaactgtagcggtgttggctggtgtcattcaccccaatcgctctttatcgccaatctgcaactccaagtagtttgggtatagatatttacggtttgtcattatttgaatggtgaaacgaaaaatatgccttggctaaaataggctgtttgtttttattttgttttaaattcacaaaataaaaacaatattaatttgtcataaccgttcataatttttcatctcattttttaatcagacacaactccgttctaactcaaaaaagtgttgattaacaagggttggacgatggttttagattgaaccctattaaatgtatggtctaacattcgccttaattaaacttgatttgtcgccgctctgaaaaataagagtggcggaaatttcagcaaataaagtaggcaaatgtatgagtgatgttaataaagtcgaaagcggtgaaaaacgctctctggagtggaagtcattcctcttcatcactgtggttctttttcccatcttaagcgtggctttcgtgggtggatatggattcattgtgtggatgctgcagatgttcgtgtttggtcctccaggtctgcacggcggtttctaaccacctccatttctactgttgaatgacttagctaagagaagaaagcatgaaatcgttaattttaaaaatgtggcacaccatgacgcgtcccgcggtacacattagcttgggggtattgactctcggtggctttatcgctggggtaattttctggggcggctttaacaccgctttggaagcgaccaacacggaagagttctgtatcagttgtcacaccatgcgtgacaacgtgtaccaagagctgcaaaccacagtgcactggaaaaaccactctggcgtgcgagcgacctgtcctgattgtcacgtcccgcatgagtggacggcgaaaattgcacgtaagatgcaagcttcaaaagaagtattcgcacagatctttggtgatttagatacgccagaaaagtttgaagagcgccgaattgaattggcaaaacacgaatgggatcgctttgcggcgaacaaatctctggagtgtaaaaactgccataactacgaatcgatggattttgaccagatgtccgcaacggcgcgtatccaaatgaagcaagcggcagagcgcgatcaaagctgtatcgattgtcacaaggggattgcccacaacttgccgaaaaacatggagagctcaagcggcttgattggtgagctcgaaggtatggcatccaacaccaaatactccaatggtgaaaccttagtcagcgtgcgtttcctccctgtgtatgaagatgatcaagccaaagtggaagcgggtctactcaaccctgcttctgaagtgaaagtgctgactgaaaaaggcgacatgatgcaagtggagatcaacggctggcgtaaatcgaaaggctttggccgtgtgatccaagaagatttcggtatgaacatcgcggtggcgtcgctactgaaagaggccgccatgtcggatgcgattgtgaccacgggtgagcagaaagtcgatgacatgacgggtctaccttgggagcaagtcagcgcgaaagtgtggatgaaaaaagaagccatgctgaacgacatcaacccagtttgggaaaaagcgcgtgaagcttacaagaccaactgttctgtctgtcacacccaaccggatgaagcgcactttgatgccaacacttggcctggcatgttcgacggtatgttggcattcgtcaacttcgataccgacagtgaagcgctggtactgaagtacctgcaaaaacactcttcagattttgctgaaggccaccactaagcaacgtcatacggagttataacatggcgattacacgaagaagttttctgaaaggtgtcgcaaccaccagtgcggcgtcgatcattggcccaagcctactgacctcagtttctgcccaagcggcagaaaccacgggaacttggaaagtctccggttctcactggggtgccttccgcgcccacatctacggcggaaaggtacaagagctgaaagcgttggagttggatacccacccaacggaaatgttgaacggcattcaaggcattctgtacagcccatctcgcgtgcgttacccaatggtgcgcctcgattggttgaaaaaacacaaatacagtgcagaaacgcgcggtaacaaccgttttatccgtgtgacttgggatgaggcgattgacctattctaccgtgaattagagcgtgtgcagaagcaatacggcccttgggcactgcacgcaggccaaaccggttggaaccaaaccggtgctttccacaactgtaccgcgatgatgcaacgcgcggtgggtatgcacggtaactacatcaccaaagtcggggattactcgactggtgctggtcaaaccatcatgccttacgtactgggttcaaccgaagtttacgcgcaaggtacctcttggagcgagattttagacaactcagacaacatcattctgtgggcaaacgatccggtgaaaaacctgcaagtgggttggaactgtgaaacgcaccagtctttcggctatctggatcaactgaaagagaaagtcgcaaaaggcgagatcaacgtggtttctgttgacccagtgaaaaacaaaacgcagcgtttcttacaaaacgatcacttgtacatcaacccacaaactgacgtggcgtttatgctggcgctcgcgcatgtgttgtataccgaaaatctgtacgacaagaagttcattgaaacttactgcttgggatttgaagagttcatcccttacgtactgggtaagagcaaagataaggttgaaaaaacgcctgagtgggcagcgacaatctgtggcgtgaaacccgatgcgatccgcgatttcgcccgtatgttggtcaatggtcgtactcagctgctgtttggttggtgtatccaacgtcaagagcacggggagcagccgtactggatgggcgcggtactggcggccatgatcggtcaaatcggtctgccgggtggcggtatctcttatggtcaccactattcaggcatcggcgtaccttcaacggggtttgcgggtcctggcggcttcccacgtaaccttgaccaaggtgcgaagccgaagtgggataacaatgacttcaacggttacagccgcacgattccggttgctcgctggattgatgcgattctcgaaccgggtaagaagatcaaccacaacggaaatacagtcacgctgcccggtttcaagatgatggtgatttcgggttgtaatccttggcaccaccatcaagaccgcaacaaaatgaagcgtgcgttccagaaactggagactgtggtgacgattgatttcagttggacggcaacctgccgcttttctgacatcgtactgcctgcttgcacccagtgggaacgtaacgacatcgactcttacggttcctactccggtaaaggcctgattgcgatgcatcgtttggttgacccgctgttccagtcacgtactgactttgaaatcatgaccgagctgactcgtcgttttggccgtgaaaaagagtacacccgtggcatggatgagatggagtgggtacgttcactgtatgacgagtgtaagaaagccaacgaaggtaaatttgccatgccagaattcgaagagttctgggaaaaaggcttccttgattttggtacaggcacaccttgggttcgtcatgcggatttccgcaaagatcctgaaatcaatgcattgggtacgccttctggttttatcgaaattacgtcacgtaagatcggtcgctacggttatgaacactgccaagaacacccaatgtggtttgagaaaaccgaacgttcacacggggggccgggctctgacaaacatccgttctggttgcaatcatgccacccagataagcgtctgcactcacaaatgtgtgaagccgaagcattccgcgcgacttacgcagtgcaggggcgtgagccagtgtacatcaacccactggatgcgaaagccaaaggtattaaagatggcgatctggtgcgtgtattcaacgaccgtggtcagctattggcgggagcggtgctgagtgacagctatccacgtggcgtgatccgcattgaagagggggcttggtatggcccgctgactgagaaagttggggcgatctgtacttacggcgatcccaatacactgactctggatcttggtacgtcagagctggcgcaagccacttctgccaatacctgtatcgttgattttgagaaattccgtggtgaagtgcctcctgtaacctcattcggtggcccaatcgaagtcatctagtcatctagtcatctctttaacgtaaaatgcgcgttatccctcaagccagcgttcaacgctggcttttttcttctcttttatccgtaaatccgcttaatctgtcgccaaatgaaccgttggatacggttggaacacacaaaacgtgaaccaattaacgtcatgcgtaagccattggtcagacactcagagcaaaaaggagagaatcaatgagccatctcagattagcgaatgggcgagaaatcctagtgcagcaagcggatattgagctggagatcgcaggcaatgagctttttgcacggtatatcgggttacacaatcgaccttttgagcgccgttatccactgtttagcactttactggatgtcgaatcggatgcccgcttagtgggggatgggtttcaaatgctgtcgcaagcctcaggtacgctaagccatatccaagaagttggacgatgcccagataacaatctcagttaccgcatctatccgcatgatgcgccaaagcgtttttacaataccttgatgatagaggccgctggccgctatctgttgtttggctttacttcttgccagcgttttgcgggcttttttgaagtgcaccgtcacccgcagcattgggtgttaagcgcgtttattgatggagaggaaacccgcccacaagactggatcaccaatcagttggaatcggtgatttgcttagaaggcgagtccatgtcggagctttaccaagcctatgccgaggcgatttctcgccagcatccgccaagaccccatctcaaagatcccgcaccaatgggctggtgttcttggtacgcttattatgcagaggtgaccgagcaagatatcaaagagaatgtcgcgatattggcggagcgtcacccagaattggaatgggtgctgctggatgacggctatcaagcctttatgggcgattggcttacgccatcccaaaaattccccagtggtattgagcaagtgattgccgatattcgcgcacaaggtaaaaagcccgctatctggcttgccccttttatcgcggaagcggattcggcagtttttcgtcagcacccagactggtttgtgaaaaatgccgcaggtcagccactcaaagccgaagagatcacttatggcggttggcgttgtactccttggtatgtgttggattgctctcatcctgacgtgcaagagcatttgacccaagtggtcaaaaccttacgtgaagagtggggcgttgaactgtttaagctggatgccaactactggggaacgctacaaggccagcgttttcaatccggtgttacgggtgtagaagcgtatcgaatgggcatgtaagccatcgcggaaggcgcaggcgatgggtggctactcggttgtaatgcgccgatgtggccttcactgggtttggtggatgcaatgcgtgtgtcggatgatgtagagcgcaatgccgatcgcttttgccaaattgcccgtgaaaccttaatgcgcagttggcagcaccggcaactgtggcaaatcgatccggattgcttaacgctcacctcgctgcccaatcaaagtgccgatcgcgccagctacgaattccaccgcaatttgctgcttgccagcggtggtttgctattgtcaggcgacccactgccgaaattaacaccgtttgcaaaacagagcctgaaacgtttactcaaacgattccaatacagtcagaaggcggccaaaatcacttccttgagtatgcgccatgccttcttaccgctgaccgataaaaatgatcttcactgcttgtttaacttcaacggtaaagctcaggagtttaccttggtcgccaatcatccggtgcaatagtatgactattggacaggagagcaattaagcagcgaaccttccaaactgctcatcgttaacttagagaaggggttacaaagccgcgccatttttacagtgggttagtttcaagtaggacgggtatatatcaattaagacagaggggctgattgcccctctgtctttcaattacatttcaaataaccaaaagtaaccgtagcccactatcgcggcgggaattgaggaatagagcgtggccattaacgcggctttcggtgctaacgcaatggcggggaataacgcatcaccatcgttcgaaatcgcattcgacaattgggccgaaaacggaagtgcacccgacaagtacagactggtgacgaggatctgcggtccgcagccgggtaagaggccaatcataatgccgagtgctggcatccatacgccccaattcccccaatttgcgccaatttcaaatcccgtaaagtgcagggtcaattcgaaggcaagaaaggcgatgatcacccacgcacttacgaagttggtatcttgcgcggctttttgcatcgggtgtgaagtgcggattttatcgtcttcactcacggttgattgataatcttcaatttcttgcgtgagcgcccacagcaacatgctgctaacggccagtaaagcaccgatccattcgatactcatttcaggcagtgacaacacttggttgatgtcgatttgaaatgaagaggcaaacgccactagggatgcagggagtaaaaggtatttccagaataacccttggagattgatcgctttaaaagagacggtgctagtggcggagcagcaagatgtccgcagtttattgctcagttcagtgagcgcaggacgcataaaatcatcccgatgcagagcattgatcactagaccagtgatacaacccgttacaaccccaatcccaatcacataaagcccagtcactggttggctggcgagcagcaagaaagcggcatcgcccatcgtggccgttaataccgcgaccaaagctccaaaacccactttgccgctgacaaattgcgtagtgacaacaatcgcccctccgcaacctggcaaagcacccagtagagcggcaatcaccacttgtaggtttcgcgagcggtgataagcgctgactaaagcgtgtgcaccatccagccagcgagacacccaatgataaattgctaaagtaaaggccacataagttgacactgcccagaatgaatccgctaaggtttcgactgtcactgcgcgagtattctcactgacaagcaaagcaaagagagcgataggcagcagcagtcgcttgtatctgaggttaaacagagagacaaggacgcgatgatttgccatgtttggccattttagagagttcatagaataccgcgcgcaatgaatgagaattattatcgacaatatagttgagaactattcgcaatttcaagcgagttgttggcagaaaaaggtttttttgatttagcaccatgaagaaattatgaaattgagtagagtgcaccctttgtttacgcccgtttgatggcaaagagaaaataggtaacagaatgattttagtcgttggtcataaaaacccagacagtgacagtatttgtagcgcattagtggcggctgagcttttaaaagcgcgtggtttagaagcgaaggcggtacgccaaggtgaaatcaaccgtgaaacgcaacatattctgaatgtggcaggcgttgagcaaccagaattacgtaccagtgtggcgggcgaacaagtgtggttggtggattacaccgatttagcgcaagcaccggatgatctcaatcaagccgaaattcttgggattgtcgatcaccatcgtcttggtgatgtgatgacagtgaatccactggaagcgtggatttggcctgtcggttgtaccagcactattttgttcaatctgttcaaaatggaaaatgcagaaatcacacgcccactcgcgttactgatgatctctgccattttgtctgacacggttggctttgcctcaccaacctgcacgcaaaaagatcgtgatgcggtggctgagttagcggtattagcgggcattaccgatctggaaggctttatcaaagcgctactgattgcgaaaactgacattgaaggcttaagtgcggcgcagctggtcgaaaaagatcttaaagcttacccattcaatggacgtgagttggtggttggtcaggttgaactggctacgctagagcaagtcgcggatatgattgatgccttggaggcagatctgcaacgtcgttgtgatgaggaatcattggcgcttgcagcactgatgctgaccgacatcactaccgcgcaaactcgtctgctgtttaaaggagaatggtcagaaaaactggctaagcatgcaaaagacggcgtactgatgatggaaaacaccctaagtcgtaagaagcaaggttggccttggctacaaacggaactggcttgattgccacttcgcggttaacattcttgttaagcaacgctcacgctgtatgccgtgggcgtttttttatctctgattgtaggcggtatcctgcaatttcatcgttcagtagaatggcaacattaggtggggaaaacatgtccaatccattaaccgcagagcaaatggcgctcatcaaccagtatgaccaagagcaacgattcaactactgcctgaaagagattgtggctaaccagcaagtgtggattttaaaagatgagcacggctgcgtaatgcttaatacggaagaggaagagtgtgttccggtatggccgcatcgtgaatttgcgcaagcgtgggcaactggcgaatgggctgagtgtgagccagaatcgattggcttgaacaaatggtttagtcgctggacacaagggttagagcaggatgatttatctgtagtggtttttccaaatgataatgaagaaggggtgattttgttccctgatgagttcgattttgaactgaaaaagcttgctaaccgtcgctaagttattgtcggccattttttgctggtgaaactgaaactagcgcaaccattcatacagcggtgaggaacgcgcgactcccaccgctttctccaatacaccttgttgctcgtactgtttgagctttgctttgagcacactttgcagttgcggttgcctcatgccactgcttaattcaggttcgtagagcagcttgagtaaaatcacatccaatggggacagcaaatcttccggcgttttatcgttaaagatcgaagggtaggcgagctctgaatcattgggtaatcccatcacctgagtgatctcctcgacaatacacgccagcagtttgccatggtcacgagcttgatcgaccggaatcacgactgaagccgcaacaatctcagaggccgaattggtggaataattggcctgacagattgcaccatgcatggtttgggtggcggatttacccgccacctcttctaaggcttgttgccactttgattgttgggtgaacacccaaattacgttggcctcagtgcggctggtcaccacctgaatcgagtgcccagtcacttgggcgaggtgttgtacatgatcgcgtgctaattgctcatgcagggctttatcaggcacttggtgatcaaaatagatgcgcagaggctcacgccatttactgagcggtttttcacctgcggagtactcgttacgcagtgcaacgttgagaaaagcccgttcaataaaggcgggatcgcgccaattctcttgaccaaaggcacagtggctaataagggtgagaagcccgagcgcaatccctcttttcatcattcaatacttaaaggtgggagccttggtaaagtggctctcaatcatgcgttgggtgatgggatgctgaggatccgccaacacttcgtgagtttcccccgattccaccacgtctccttcatgcatgacgatgattttgtcagtgatgtgcttgatcactccgatatgctgggatacatacacaaaggagacgcccatctcttcttgcagttccaaaaacagattgaggatttgcgagcgcatcgccatatccagaccgttcaacgcctcatcggcaataatgatggaaggctgtaagatgagcgcacgagccaagcagacacgctgtttttgtccagtcgccagcatctgcggatagaagtaagcatgctctggcagtaaaccgacacgttgcaacgtatcttttacgcggcgcattcgcgcttcaggtgtcatgctggtatttcgtttcagcggcccttccagaattgttccgatctgtaaacgtggattgagcgaggtattcgggtcttggaaaatcatccggatcaatttacagcgcgtcgagtagtctttgtgttctaacaactccccgttgacgcggatctcgccaccggtcggtgcaaccatccccgctaacatgcgagcgagggtagattttcctgagccattttgaccaataaaaccaatggtttgtcctgcttcaagagtaaagctgactggctttaccgcatgttggatctgtttgcgtaaaaagcctgagcgagtgacaaagtctttgtgcagattggtgacttctaacagcgcactcattgtggcgactccatattgagcgggaaatggcaagaaaatttatggttttttacccagcgtgaatgagggacttcaacacactgacgctgagcgtaagggcaacgtggccctaagcggcagccaatcggtaagtgttgcagtggcggaattgagccggggagagattgtaatttctgtttgtgcgggatccagtcactaaaatctggcatggctttcagcagcgctgcggtgtaggggtgctttggctctgccacaatttttgcagtttccgccgattccaccgattgcccgcaatacataaccgtaatgcgatccgcccactgagtaatggtggttaagtcatggccgatgagcaggatcgaggtgttattgacctgattcatgcgactcagcaaacgcaaaatttgcgattgagtgatgggatccacgtcgttggtgggttcatctgcgatcagcaatttcggtttagcggcaatggccatcgcaatcatcactttctgacactcgccatccgtcagctcataagggtagctagacatgatgtctttgtgatctttgatgccgactttgtgcagcaaagcaatcgcctgctttttccgccatgtgaaacgctcccaccagcgtccttcgaaggtgcgaaatgggatggactcaatcagttgtcgtccaacctcttcagatggatcaagacaggtggaaggctcttggaaaatcattgccacatcgcgtgcgatcacgcgtcggcgttcacgcggggtgagctgcaacaaatcaatattgccaagacgcatacggtcagccgtgacgcgccagttttctttacagataccaacaatcgctttcgcaaccaagctcttacctgagcctgattcacccactaagccacgaatttccccttcattcatggtcaagctcatacgatcaaccgctttcacaagaccttgtggagtatcaatctcaatcgtcaagtgacgaatatcaagtaacggcattattcgactcccgcattgagggcttggcgtgcaccatcgccgaccaagttaatcactaccaccgtaaacataatggctaagccggggagagtcactgtccaaggggcaatatagatgagctcgactgaatcaccgagcatcgctccccactctgtactgggcgattgagcaccaagccctaaaaatccgagcgcggtgatatccagaatcgcaatcgagagtgccatggtaatttccgctacgataatgggcagaatattaggaaaaatggaatgccagagcagataaaattcattcgctccgtctaatcgcgctgccatgacataatctttttccacttcattgtgtaccgcaacatacacggagcgaataaagcgcgggatcagtgccagaccaatcgccagtaaaatgttgaactcaccggcacccagaaaggccacaaaaatgatcgccaatagcagtgaggggatagacatcaccgtatcgagaatatggtttaaggtactagaaagcagtcctttggtcatgccagccagtgcaccaatggttccaccgactagggttgcaatcagtgtaatcaggacggcagcacctatgctaaacagcgaaccatcaatcaggcgagacaagatatctcgccccagatcatcggtgccaaggaaataatcaacggtaccttcgggctcccaagaagggggcaggagcaatacgctggagtgcatttgcgggtcgtaaggtgcaatccaaggcgacaaaatggtcaccaatgcaataaagagcaaagaccacaagccaaacatggcgagattgttcgcgcgaaagcttcgccagaaacgctcaaactgggttggaatatgttcttcttgataaatactatcgcttaacataccactctttccttaccaaggggttagctgctgcgccaatcaaatcagagaggatattggccgttaagaccagagtaccgacaacgataacgcctgcttgaatcgacataaaatcacggttggctaatgcatccaataaccaacggccgatacccggccagttaaagatcgattcagtaataatggctaaggtcagcatgctggaaagttgaacgccaaatttcgggatcatcggcggaatcgcattgcgtaaaacgtgctgagtgacgatttgatagttagacaagcctttaattttggcggcacggatatagttttggttcatgacttcggcaaccgaagcgcgcatttggccgatgacttgcgtggtcggcgccagcgccagcactaagcagggcagcgttaaatgctctatcacactttgcagcgcttggctgcggtagggggattgagacaaaaaggcatcaatcagggcaaagccggtaacgtgatcaatttgatacagcaagtcatagcgtcccgccacaggaaataccgggaaatgcagtgaaaacgccatgatcatcatcagcgccagccagaaaataggggcagaatatcccgacatcgaaatgaacgagataatagtgtctaaccatttcccttgtcgcattcccgccagtgttccgataggaattcctacgagcaaagagaggataaacgcgatggtacacagctcaatggtggccggaaataccaccagtaactcatggagaatcggtaccccatttttattgaggccaaagttgaattccatcagttgcaccaaatagcttgaccatccttgccaaaagccgatcagcgtccaaggcgagtgcgggtcaaatctggctaagctgtagccgaccatggtcaagataagcaaggtgatgataaataagttaaatttacggaccgtatagacgaacattactcggccaccctctcgacagtattaaacggttggacattaaatggactaatgcgaatgcccgttaatgatttgctataagcggtaaactgtatgccgtgggcgagaggaatcaccggaaactcctgattgaggatattttgcgcctgatgatacagattgaggcgatagcgcggtttattggcttctagcgccaagtccaacagaaaatcaaaatcactgtcgcaccacatggaaacgttgagacctgcgcggttggaatcacaagagagtaaggggcgtaagaagttatctgggtcacccgtatctcccgtccagccacttaagtacaggtcaatattgttgcgtatactcagctcttggcgctctgagcgatcttcactgatgaggcgtaatgtcaccccaatgtcggcgagattcgcttggatcagctctgccgttttgcgcgggctaggattgtacgctttcggctctacaggtactgacatggtcagctccagacccgttgcaaatccagcttcacgcagcaaagcttgcgcgtagttacgatcgtagcgaatctgcgccgtatcttgctgataggcccaagaggtggggggcaagatggtaaaagcgatgcttccggtaccgtaatagacagaatccaagatattttgtcgattaatcgcgaaattgagtgctttacgcacgcgattgtcatttaacgcaggatgttgagtgttcaccgcgataaaggccacattcatcgcaggtgtggtttgcagcacaatatctgggttcttttcaatcgcaggcagttggctggaaatcggtgcattgagcacatcacattcattgcgcagcaatttggccagcatgccagtcccacgttgtgaaatatcaaacaccacttgctcgacttttgccgcaccttcccaatattggggatgacgtttcaagcgaattaaatcgcgcggatggtattcggcaaggtaaaaaggcccagtacccagaggaaggttatccagcttctctttttcatcatcaatgatgagctgattggcgtattccaacgacagaatcaccgcgtggctagtggcgatgttggataaaaaactgttatcaggccggctaaggacaaactttacggttaagtcatcgagcgcgctgacatcaaccaatagattctgaaaatcaatgcctttaaaccaaggatattgagtttggcctactttgtggtagggattggtcgggtcaataatgcgtcgaaaactgaacacgacgtcatcggcattgaggggacgtgtcgggctaaaccagggagtggtttgaaacgcgacatcgggacgcagcttaaacacatactcaagtccggtgctattgacggtccagctactggctaaactggcaacgggtaagtgtgtttcggggtctattgtcagcaaggtgttgtagatctgcggaccgagtgcatcagaggtgatatcgttatccgccaactgcggattaaaggtggtcggcgcactttcaccacagtagacaaagccgctactgcggatcttgctgtggtcgatgttttctccgcagcctgccagcagagtcatgctgcacagccctagcgtaaatcgtaataatgcattcatagtgatctgagtcagtcacgaggcgttggccagagtctggcaagcctcaaaatcccgctaatttaccattgtttttcgaacgaaaccaagtgaaaaggcgcatttaccgcatatcactcaacgtgaggcgaggcgttttcactgttcatttgtgggtactttctcatcatgcctcgaaattgatgatagctgagtcccagcaactgcgcggcgtgcttttgattaaatttcgcttgcgtgagtgccgcttgtaacaactcaatatcacactgttgctgccatgccttgtagtcaagaggcaaatggaagtcggtacgagtggtatggcgaacgtcaacctgctcagactcatcggtgacaatgtcactggattggaacgggttaaagactaactgatcaattggttggctattcaacccatgttgatacaccgcgcgctccaccacgtttttcagctcacgcacattgcccggccaagagtaggcttgcagttggtgtaatgcattggggctaaagccaacaaagagtggcagttgtagttcacggcacatgcgaatagcaaaatgttcggcaagcagcgcaatatcttctggccgatggcgaagtgcgggcaaatgaatcacgtcaaacgccagtcggtccagtaagtctgcgcgaaatgtgccttgctgagccatttgcggtaaattcgcgttggttgcacataccaagcgcacattcgcgtttaatacttggttaccaccgacacgttcatattggccgtattcgatcacgcgtagcagtttttcttgcactgagagtggtgcagtggccaattcatctaaaaacagcgtaccgccttcggcacgttcaaaacgtccttgatggcgtcctttggctccagtaaacgagcctgactcatggccaaacagctctgaatcgatcagtccttcactgagcgtcgagcagtttagcgacaccagcggttgttcccaacgttttgataaatagtgcaagcgctgggcgatcaactctttacccgttccgcgctcgccaatgaccagcacaggacgatcgatcggcgctaaacgtgagactttgtctaacaccgctaaaaacgcaggtgactctccgagcaagctctgttgcattctctatttcctcaaagtggtgaaattgaccaactgttggcgaatttcatcatagcatgctaagtgaaaaagtcggtatatttgtaattgtttgaaaaatatggatttaaaagttggcacgtaatttggatttatctttgcaaccaacgcacagcatggggctgcagcggtaatctcagtgtttggcactgaaggataggagaaacgtcatgggtattttttctcgttttgcagacatcgtaaattccaacatcagcgcgctactggacaaagcagaagatccagaaaaaatgatccgcctgattattcaggagatggaagatacgttagtggaagtgcgtaccaattccgccaaagcaatggcagataaaaaagagctggcgcgtaaagtggagtcgattgaacagcagttagaggattggcagaacaaagcgacattggcgctgactaaacaacgtgaagatttggcgcgcgcggcactgatcgagaagcagaaactgcaacatgtgttgaaaggtttgcacacagagcagatgcttgtcgaagaaaccattgaaaagctaacaggcgaaattggtaagctcgaaaccaaaatcactgaaactcgtgcgaaacagcaagcgttagcgattcgtagccaagcggcgagtcatcgtcgcgatgtgcagcgtcatttgcacgcgggtcgtaccgaagaagcgatggcaaagtttgagcagttctcgcgtaaagtcgatgagctggaagcggaagccgatctttatgcacaatcaggccaagcgcgctctttagagcaagaatttgctgagctacaagcacaagatgagattgaaaaagagctcaacaagcttaaagctcagatgaaatcagaccaataattgggagtagactatgtcctcattttttatcgctgtgccattgatcgttttttgtatctttgttgcaccgctgtggctgatcctccactaccggagtaaacgcaaaaccggggatggtctatcggatgaggagctgcaacttctgcgcaccctgtcggataaggcaaatcgcttgcaagaccgcgtggaaaccttagagcggatcttggacgatgaaaccccaaactggagaaatcgctatgagtaaacgcgagctgtaccgcgacccatataacggcaaaatagcgggggtttgtgcagggttagcgaattacttcggcctagaggtttggctggtgcgaattttagtgatcaccgcagccttgctgggtgggacgtttttagtgctggtcgcttatgtggccatggctctgatgctggagaagctaccgaagcagtaccgcgaagatattcgtagtcagcaagcgcatacgctgaaaagcaaaccttgggcacaagggcaagcaccaaaagagctgttgcacacgctagatcgcgatctcagccaagtcgagagtcgaattcgtggtgtggaggcgtatgtcacctccgaagcgtttaaggtcaaccgcgagtttcgcaaactctagtcaccagcgccaattacaaatcgtggtgaatagataggcgcgagttattattgagcggtatgaaatgccgctctcactttcgctaatatttggtgaaaaatcgatggcgcgagtggagttaacgcactgattcacctatgtttgagctatgtctaagcataggtaattggtatgaacaaaacccttttggccttttctatctgctccactttgctggtggggtgtggaaaagagcttcctcccgtgcctgagcccgattcgcggccagctaaattgacgactgtgtccgtaggtaacaacaccttttctcgccaatttccagccactacggcggctggcgatcgcgcggtgctcgctttccgtgtacccggacaactacaaaccattgatgttttagccggacaagaggtgaagaaaggtgaggtacttgccagactcaaccctgacgaatatgcgttgttagaacagcaagccagcgccaattttcaattagccgatgtgcaatttcagcgggcacagcgattacgacaagacaaagtcgtttccgagcaggatttcgaccaagctcaagccaatcacaattccgcgaaagccacctgggaacaagccaaagccaatctgcgttatacccaattgatcgccccttatgatggcactatttcgctgatcccagcagagcagtatgagtatgtcgcagccaagcaaggggtgatgaatattcaaaccaatcaactgctcaaagtgcagtttctccttcccgatcatttgcttaatcgcttttctcgcgatggtgtagaagcgcatatggtgtttgactcgttccctaaccgccaatatccgttgcaatttcaagagatagataccgaggccgattccaaaacccgctcctataaagtgactatggtgatggaaagacccaatgatgtcggcattttgccgggtatggcggggcgtgtaagcctcatggctccgagcggtagcgcgacggtgatccccacttctgcattgtttgcagagcaagggggaaaatacgtatggcgagtcgatgacgcggggctggtcagtaaagctgcggtcactttgaatgaacaacgccaagtgcttacaggcttaaatgatggcgaccggatcattatttccggtgtcagtggcgtgaccgagggcataaaagtgcgtgaatgggtcaaggagcgagggctgtaggatgaaaataattcgttacaccgcttggttggctcacttactgttgatcgcaggatgcagtgaacccacgaagctcgaacgcgatacgctaccgcgagtaaaggtggcgcaggcaggtgaaaaagtcagtgataagctcttttttcctgcggtggccaatgcggctgaacgttctcatttgagttttcgagtggcaggtgaaatcagtaagttccatgtcaaagagggcgctcgcgttaagcaaggcgacatcttggctgaaattgagccgaccgattaccgtttggctgtcgataatgctcaagcacgattttccgtgattgatagccaatatcggcgttcacaaccacttgtcgaaaaaggcttattagccaaatcacagtttgacgaaattgctgcgcagcgccaaatcgctcgtgctgagcttgagttggcgaaacttcgtctctccttcacccaattacgcgcaccaatggatggcatcatctcgcgtgtcagcgctgagcagtttgaaagtgttcaggttggccaacaaatcgtcaatattcacaatatcgatagcgttgaagttttgattcaactgcctgatcgcctgtatgcgacacaaccgacggccagcgagttggcgaagatagaaaccgtggtgcgtgtcccaagtggtcaagtttatcccgcacgtatcaaagaattcaccactgagccagaccctgccacggggacatttactgtcaccctttctctgcccatgccagagcaagaactgatcttggatggcatggctgttgaagtgagtgccaaagggcaacatgtcgggctaaacccactcaataccatcagtattccgattgaggcgattttgaatgcagacggtgatgagttagacaaaaccgctcaatacgtttggttgctcaacaacgacaatacggtgagcaaacgtcaggtgcggttagcgaaagcgtcacgcagccatgttcaagtcagtgaaggaattaacgcgggagatcgtttagtggtcgctggcgttgcaagattgagagatggaatgaaagtacaagtccttgaggagcgtggccatgagtgaacagaagcagaccccgccagagaataatgagaaccaaggtgttgctgcttacttcatcaataatcgcgtgatcagttggatggtttcgctgatttttttgattggagggacggccgcattttttaatttaggacgtttggaagaccccgcttttaccattaaagatgccatggtggtgacctcttatccgggggcaactcctcagcaagtggaagaggaagtaacttatccgctggaaaaagcgattcagcaattaacttatgtcgatgaggtgaattcgatttcgagccgtggtttatcccagatcacggtgacaatgaaaaacaattatggcccggatgatttgccgcaaatctgggatgagctgcggcgtaaagtgaatgatttaaaaggcgctttaccgccgggggtgaatccgcctttggttatcgatgatttcggtgatgtgtatggcatcttgttggcggtcactggcgaaggttacagctacaaagagctacttgattatgtggattatctgcgccgtgaattggagttaattgatggcgtcagtaaagtctcagtcagcgggcagcagcaagagcaggttttcatcgagatctcgatgaaacggatcagcacgctgggaatttcgccgcaaaccgtcttcaatctgctctcgacacaaaacttagtctcggatgccggagcgatccggatcggctctgagtatattcgcattcatccgacaggtgagtttgacgatgtggagaaattgggcgacctgatcctgagtgaaagaggcgcacaagggctgatttatctacgcgatgtggccgaagttaaacgtggctacgtggaagttccaagtaacgttatcacctttaacggtaagctcgcgcttaacgtgggggtctcgtttgctcaaggcgtcaacgtggtggaagtcgggcaacgcttcgatcgccgtttggccgagctcaaatatcaacaaccgatcgggattgatattgccgaagtgtatagccagcccaaagaagtcgataaatcggtcagtggttttgtggtgagccttggacaagcggtcgccatcgttatcatcgtattattgttctttatggggctgcgctcggggctgttgattggtcttatcctgcttttgactgtactgggcaccttcattttcatgcagtatttcaaaatcgacctacagcgtatttcattgggcgcgctggttatcgctttagggatgttggtggataatgcgattgtggtggtcgaggggattttgattggcacgcagaaaggccgaacgcgcttgcaagctgcaacggacattgtcacccaaaccaaatggccactgctcggggcgacagtgattgccgtgactgcctttgcgcccattggcctgtcggaagatgcaacgggtgaatactgtggaaccttgttcacggtattgcttatttcgctgatgctgagttggtttacggccatttcgctgacgccattttttgccgatctgttcttccgtggtcagaaagcgccagccagcggtgaagaaagcgatccctaccaaggttttatctttgtggtctatcgccgattccttgagttttgtatgaggcgcgcttggctaacgatgggcgtgttggtgctcggacttgcagcgagtttgtatggctttaccaaagtgaaacaagctttcttcccatcatcgactacccctatgtttatggtcgatgtttggatgcctgaagggacggatattcgagcgacggatgccattttattagagctggaaaaatggttgtcggctcaagaaagtgtcgacagcgtgaccactaccgcaggcaaaggtctacaacgcttcatgctgacttactcaccagagaaaagttatgccgcttacggtgagatcaccacacgggttacggactaccaacagctcgctgccttgatggcgcgttttcgggcgcacttagacgcccgctatcctcagattaactacaagctgaaacagattgagttagggccaggtggcggagccaaaattgaagcgcgcattgtaggttcagacccaacggtactgcgcagtatcgcagcgcaagtgatggatgtgatgtacgctgaccccggtgcctacaacatccgccacgattggcgtgaacgcaccaaagtgttggagccgcagtttaatgaaagccaagcgcgtcgttatgggatcaccaaggcggatgtggatgagtttttagccatgtcattctcgggtaaaaccataggggtgtatcgggatggcaccaccttgatgccgattgtggcacgtttgccggaagaagagcgggtggacattcgtaatatcgaaggcatgaaaatctggagcccagcactgagtgagtatattccattgcagcaagtgactcttggttacgaaatgcgttgggaagatccgctgattgtgcgtaaaaatcgtaagcgcatgctgacggtgatggcggacccagatttgttaggcgaagaaaccgctgccacgttacaacagcgtttgcagccacagattgaagccattcctttaccgccgggttatttccttgaatggggcggtgagtatgagtcatccggtgatgctaaagcttctttgtttaaaaccatgccattgggttatttgttcatgttccttatcaccgtattcttatttaactcggtgaaggagtcgctgatcgtttggctgacagtacctttggcggtgatcggggtgacgacaggtttgttggcgctgaatacgccgtttgggtttatggccttgctcggcttcttgagtctttcgggtatgttactcaaaaacggcattgtgttactggatcagatcgaaattgaaatgcactccggcaaagatccgtatttggcggttgtcgatgcgtctttgagccgtgttcgccccgtctgtatggcggcggtcaccaccatactcggtatgatcccattgctgccggatattttcttccggcctatggcggtaaccatcatgtttggtttgggttttgcgaccgtactgactctgattgtcgtgccggtactgtatcgcttattccatcatgtaaaagtcccacaatagcgataatgtcagtgaacgctgattagagaccttaaaatacgtggctctttggagccacgttgctcattgaatgaagaaggataagcatgatgaatgcggaacagggcgtatgtgcttgggcgatgaaccatcccttagagcgtgaatatcacgataaagagtggggcagagctgtgcatgatgataccaagctattcgagtttcttacattggaaggggcgcaagcgggattaagctggctcacggtattgaaaaagcgcgaagggtatcgccaagcctttttaggttatgatttacagcgccttgcacagtgtgatgaaagccatgttgagcagatcattgccgagtatgatgtcgtaaagcatcgcggcaaaattgcttctgtgttctcgaatgcgcgagccgccttggcgttacaacaggagttcggctctttagatgccgcgttgtggcaatttgtcggtggtcaacccaaaatcaaccgctgggtaagcatgagcgatgtacccgcctcaacggaagaatcaaaagccatgagcaaatttctgaaaaaacgtggctttaagtttgtgggcgaaacaatttgctatgcctttatgcaagcgtgtggtttggtcaacgaccacttagttggctgtcccaatcactctaatgcagacaagctctgattcaccaagagctggtttgggaaaatacagaaaatcaaagcaaataggggctgaagcccctattttgatcatggaacgaaaaactgctatgcatgcaggatttggttgtagcgcgcaaaacccgcttccagatcggcgattaaatcttcgacatcttctaacccgatatgaacccggagtagagtgccgcagaagtgagggtttgcgactgagcgaagagaggtaaaggctttgggttcgtgggctaagatcaaactttcaaatccaccccaagaaaagcccatgctgaagtgttgcatgccatcgagtagagcggttgtggcttctggatgcgtcgttttcaacacaaaagagaacaagccattgccgccagtaaaatcacgttcgaaaaactcgtgccccggacaggtcgctaacgcagggtggcgaacatgatcgacttctgggcgagtttgcaaccactgggcaatctgtaaactgttttgttcatgctggcgtaaacgtacatcgagggtgcgcaatccacgcattgccatgtacacatcgtcaggtgaggcatattgtcccatcaaatagctgtgttcacgcagttgtgcccaacacttctcattggcgaccgcagtaccgagcatcacatcagaatgaccgacaatgtatttggtcgctgcttgaatggaaatatcgacgccatgttcgaagggtgagaacagtaccccagccgcccaagtgttatccaacatgacaacgatgtcgtgctcgtgagcgatgcgagagagtgtcggaatatcctgcacttccatggtcagtgagcccggtgattcggtaaacagaaccttggtattaggttgaatcaactcgcgaataccttcgccaagcataggatcataataggtggttgatacaccaagttttttcaggactttctcacaaaagtcacgggtgggttcgtaacaggtatcgaccatcaagatatggtcaccttgcgcaacaaaagagagaatcgcgttggtgatggccgctgcgccacaagggtagagcacgcaacccgcgccgccttcaatctcaaccattgcttcttgaaacgcgaagtgagttgtggtgccacgacgtccgtaaaacagggttttgttggcgcgattgatcgccgcttggtttttttgtgcgaccgtatcaaacaccacagtagaagcgcgttgtactggggggttaaccacgccaagtgtccattttttgttgcgtcccgcggtaacgaggcgggtctttttaccttctgacatctgctgtccttgtctgactttacaaaacgttatttaaaccatggtgccgtgccggatggcaaccccactcagtgagaaaatcacaataatgggttaaagagataaaatacgcgctccaagaatcggttgtaccatgggcgctgctcccactcggcataaacgacggaatgagactgatcaatgtactgctgctgcagccaatgcatctgttgagtaaattccagatcatccactgcgagtgtaagctcaaagttaagccataagctgcgcatatccagattcaccgtccctactaaacagaactgctggtcaatcacgacagacttggtgtgcaacaaacctccatcaaactcatggatctgtacgccagcttcgagcaattcgccgtaaaacgctcttgaagcccattgcaccatgagcgagtcgttctttttcggaataataatgtcgactttgatgccacgttgcgccgtcatttttaatgtggccagcaaatctgcgcttggcacgaaataaggtgtagtgatgcagactgagcgattggcttggttgatcgctaacgtcagcacttgagaaattaaattctcaggcataccagggccagaagggacaacttggattggatgctgaggctgattcggttcgaggcggcattccggatttttcggcaacatgcgtgagccggtttcaaattcccaatcccagcaatgaatggccgagaggacattcacggtcggtcctgtcactcgaaccataatatcgatccactggcccacgcctgcattttgcttgaagtaggcagggtcaaccatattcatggagccggtgtaggcgatttcatcgtcaatcacaatgattttgcgatgttggcgcagatctagccgacgtaggaagatccgccaagggctgacttctaacgcttgtactacctcaattccggcatcacgcatcattttttcccaagggctacggaaaaaacgtgggctgccagcagaatcgagcaacagtttgacgttgacaccgcgttttgaggcttgaatcacggccgaagcaacggcatcggctaaaccaccaggatgccagatgtagaacaccatacgaatttgaaactgggcgcgttcaatatcatcaatgatggcgtgcaagatttcattcggagagttgagtaaagataaggtattgccactgagtgcgggtatgcccatccggttgttacacagctcatcaattcgtgagatgtgtgctcccatcccttcttgtacatgggcttggcaatcattgagagagcggaaccagtggccgaaaggcgtgaacatctctttagcacgttcggctcttttacggccgaggttgagttccccaaacaggaaataacagagcacccccacaaacgggatgatgtatatcaccatcaaccaagctaaagaaacgctgaccgcacgtcttttcaagacaacgcgaatcgtgacaccggcgaccaaaagccaatagatgccgatactgagcaaagtgaggaagtgataaaccttgtccatgcctatccaataacaaactgatattcaaaggggatagtaaagcgaaagcataagagaaggaagcgaactggccaaattaatacaatagttaggcttatcctgcttgaaacggcaagtcgtccgagtatatccctttccaatttgaagctgcagcggtgttggctacgttcgtttaccccaatcacatagtctgcctatgcatggggattatgagagccatccttggctctcaccagaggctagccttcggctgtgcaaatttgttcccgacaaatttgtcactcacttgccgcctacctgcaacttcaagtcgtttgggtataggtaggatgttgttgttattaatttgtaaaaatgagtgtaagacgtcaagctttggatgaaaaacaaacaaacgcaccagaaatattactggtgaatagcaaaatagactgttcgggcttccaattttattcttgaactgatttacttgccatacttacaaagttagtgatgattttgtcatgtgtaattttatttttacacctacaatcataagcaaacaaacacaattcattggtagcaaatatggcaagtggttctagaggtcagttcacctctcgatttggatttattatggctgcagcgggttctgcggtggggcttggcaatgtgtggggcttcccaactcaagctgccagtaatggtggtgccgttttccttttggtttatctctgtatggtctttcttctcgcttacccgatgttggtggcggagttaaccattgggcgttatggtcaatctaacccgatacgtgcatttcgctctgtttggccgcaaggcaaatggggtgcgattttgcttggtgttatcggcatggtcgtggtgtcacttatccttagcttttacgccatcgtcgcaggctggctagttggctccctgtttggtagtggcttaacgctgattggtgccgacagtgcaagtcagtggctaacctcgttcagtactgagcgaaatctcattctgatggtgtcattcatggtattgaccatgtttgtggtgcgtaacggtgtcgctaacgggattgaaaaatggtctacccgtttaatgccactgctatttgttttgtttggtttactgacggtgtacatcttcactcaagagggtgctctggatggactcaaaatgtatctggtaccagatttgagccactttacgcctgatgttgtggttagtgcgatgggacaagccttcttctcactatcactgggtgtatgcgtgatgaccacttatggctcatacctcaacaaagaagcaaatttgccgaaaactgcagcacaagtggctttgattgatactggtgtcgccttcattgctggcttgatggtactgcctgccatgtttgttgcgaaacacaacggtgtggagattttctcttcatctggtgagttactcaattctgataccttagtctttaccgtgttacctgcgatgtttgacaccatgggggcggtaggtgctgtgattggtattatcttcttccttttgatgatcattgccgcattgacttcttccatttctatgttggaagtgcccgtcgcttgcgcagtggaagagttacagcagaaacgatctagtgcggtgttatggattggcggtttggtcacgatcatttcaggtgtgattgtgctgaatttttccagcttgtttggtttagtgattaatttcaccacggtttactcgcaaccgatcatcgcacttttgattaccttgattgcgggttggatttggaatcgtaaccagatcctatcggagctgaaacaaggctgccctgacattgaaaacagcctattttggaaaatctggccttggtatgtgcgtcttgtctgcccggttctgatgttgatggtgtttttcgcttaagtaacctgagtaacagaactttgcagataaagcggcttttcagccgctttatcttttggttttgggtatataatcacgccgcaaagtgaggcgtatttatgtttgatattctgtttacccatcctgattttctgcttatcaataaacaccccaacgtatctgtccataaagatgatggcgataccatgttgctgcaagaagtggcgacgcaaacaggggatggtcagctctacttggtgcatcggttggataagatgacgtcggggattttgctgttggcaagaaatgccaccgcggccagtgagctttcgcaaggttttgctaagcgcaaggttgaaaaattctatctggcgattggcagtaaaaagccgaagaaaaaacaaggtttgatctgcggagatatggagcgctcacgtcgctcatcatggaagctggtgaactcgcaagaaaatccggcgatcacgcaatttttctctgcggccgcggcaacgggggagcgcttgtttttgtgtaagccccataccggaaaaacccaccaaattcgcgtagcgttaaaatcgataggttctgcgattgtgggggatcctatttacaatacggcggatgagtctgatcgcggttatctgcacgcttttgccttgcgttttacctatcaaggtgaggtttatcaatggctgtgcgatccgcgccagttttcacacttaggtcaaaaatggcacgaagaagcggtgaatcaagggattgaaaattggctatcaccttgggatttaccttggccagcgctgaaagtggtggtgaaagagtaggcgagcgttctcattgtgccctcaacgtgtcgatcaactcacgttgagggcgcgaactttacctttgttcgacgtgttgcaaggtttgaaaaccgtaatagatgcgggttgccgtagtaaaccaacaggcagcaccaaacagccaagctagggttgaaaaagagtgaggcaataaacacatcaacatgaagcaggcgatggtttccgtgccctctgtcagaccgctcatgtaatacaaggatttgtgctgatacaccggattggtgatgttacgtttactggccatgactgcaaaagcaagaaagctactacccgtcccgataaaagcaaaaatcaagaaagcgcccgcgaccgcgttatgttctgggtttgcaaggacaaagccaaacggcactaaagagtagaacagaaagtcgaggctaatatcgagaaatcctcccgcatctgtcagcccttggcggcgcgcgagggcaccatccagtccatcacagatccgattaaccacaatcaataacaaggcgagccagtattgctgcattgcaagcgcaggtaatgctaatgccccaatcacaaagccgaataccgtggtttgattggcggtgacgcccgcttcatccagcaatcctgcggcttgatgaagtggccagcgaatgatttttatcgcgtagcgatcaagcatggtttacctctgtttcttgctcaatgacgggccattcaatgacacgactgcccactggcacatcctcatgatcatgagtgaccatgagtgttgggatccctgcgctggtcagttgattgaaaacccaatctcgaaattggctgcgtaaggctttatctaatttactgaagggttcatccagcagaaccaatttgggctcggcgagcagcatgcgcatcaaactgatccgtgcccgttggccaccagagatctgctcgggaaacgagcaagccagctcagtgagggcaattttcgttaaagcggcataagcgtttttcttacgttgttcgcctttaatcgaattcggcaacgcaaacgctaagttttcccacacattgaggtgtggaaaaagccaatcgtcttgaaaaagcatgcctacttggcgttgatgagccggtaaggtgttgagctgcgtatccccaagtttcatcgaaccttgaaacgtaaaatccgtggcgagatgacccgcaatcacgctcagtaaggtggatttgccgcagccactagggcccattaggctcacaatctcgccttctgcgatagtcaaattaaactctgccaaaaggcagtggccatcttgtttaaggatggcgaggttttcgagagaaaatatcatgaaataccgttgtcaattgtgctgctcggtagcggtgaatttgcatacgtccgagaagcagagctattgaaaagaacacgaaaggcaggagtgcttggcagagggcgtaaatggctgtcactcgacgatcgtaaccgctagaaagggcaacggcctcggttgtgatagtggttaagcgtccgccgccgagcatcaaggtggggagatactgcgccagactgacactgatcccgacggcccacgcataaagcagagcaggaaacagcaatggcaatttgattttccagaaaatttgccattcgctcttacccaaactgcgtgcaatctttgagaaattcgaattgtagctttgccaagggccacttaaggctaagtaaactaagggaaatgcaaaaaatgtgtgtgcccataccacccaccaagtataggcttgagaagccatcagcagagtcaaaacttgaataccgaacaacaaggagagctggggcagcaacataggtaacgcgatgatgtaaaccgggatcgcccgttgagtgtgcagccgatactcttgggcaaggatgcccaacaataacgctaagctaccggagccaagggcaagcaaaacgctggtttccatgttgtgcagaacattcggccactcgtcataccaaaattgtccggtccattgggttgggaagaggtctgggaagcgccagcgctgtgccaaactccaaatcaatgtgagcggaatcatggctcctgaaatggtgaacaagagcgtgagtatgcttttgtgaggcaaaggaaagtgagagcgaccagaagactgccacgcgcgatagccgcgagtgaataaccactcaagcgcaacaatcgccactaacactatgcttgcgagaagtaatagcactaccgcaccagaggcggctctggggagtaggttcaaatcgggttcattaaaccactgccaaactaggactgaaaacgttgggggagtagtcggccctaacactaagctgaaatcgaccacggaaatagcgtatgcggcgacggcaaacaaagtaaagcggattttgcgcagccactgcgggaaaacaatcttccaccacatttgtggctccgaataacccagtgaagcactgagcattttcatcttggttaaattcaactgctgtaaaatgggcaagctgatcaacagaataaatggcacttccttcagcgccagagcgatagtaaggccgatggcgtaagggtcgtgcaccaaccacgtcacctcatgcgagttgtcacggagttcgaagccataatagagcagacgagccaaccacccggtcgaggcaaacaaagaagcaaaaccgatcgcgaaggccacatggggtaaggcaagcaggatagataaactgttttctatgcgcttccagcgaggatgaaaccaaaatcgctgcaaaatggcgaagctcatcaagagggcaagataagtgctgaatagggtcgaagtaacagaaaggagcaaggcgtattcaacgccttgccattgccaaacttgactaaaaccctgccaagatacgtggtgatgcccaagtacgggcagatagcctgaggctgagatcaagactcccgccaacccaggtaggatcggcgcgacacaaagcaaaatgaaaccccaataggcagttctaagcatggtctgacaaccgttactttaagctattaccgtagcgcttttgccattctgcttcgagcgcgctttgccaacttgggtgcggctcagcaatcgcagggaataggatggtatttttggcactgcctgtcagaaactgaggtttcaatatggaagggtcgccccaaatagacaaatcccctttacgagattgtgcttcgtcactcaggaggaaattaatcgccaccagcgccccttcttttgcgttagcgttccaaggaattgctaagaagtggatattggttaaagcgccctttttcatcgcatagctttgcgctgtcggtgcgagcttgccagtagcttgcgctgaaaataccgcattcgggttaaaggtgatcgcgaggtctagttgaccatcatccagcagttgcatcatctgggcagagccagcgggaaactgtttgcctttgcgccaagccacagcatgcaattcatctaagtattgccatagtggttgggtgagctgctcaaatgtggcaggctctacggcttgattgagttctggcgcatagtgagtcagttcgatcagggctgctttcaagaagctggtaccatgaaattcagggggctgtgggtagctaatgcggtttggaaaagcctgcgcatagctgagcagctcggcaaatgaagccggaggattgttcacttgctgcttatcatgaataaacaccaattgtccgacgccccaaggcgcttctaagccttcagttggctcggaaaaatcgctgtcaacgggtaagcttttgtcgactttcggccagttaggtaaatcttcgacaaatggcccgtagagtaactggttgtttttcattgatttgaagttttcaccgttaatccaaaccaaatcgacactgccttgctcattttttcctgccgctttctctgcgatcaaacgggtagtcgtttcggcgatatccgttactttcacatgctgcaaggtgacgccatagcgggatttgagtaggtcagcagaccagcgcaagtagctattaatctcttggctgccaccccaagcatggaaataaaccgtttgtccgcgggctttctcggtagtctcttcccatgattgcgcagaaacgccaaatgagagggcgcaggtcgtgagaaaagtcagcatttttttcatgaattgtccttaaaatttcggctttacagtatttctagaccgggtgaaagatgcttgtctttcattatgaaggaaaaaattcaaaatgcttgttttgcttgccttaagtgtggcgaggtcaggattaaatagggtgaaataaaaacggcagcgatgtgcgctgccgttatcttatgccgacgttaagctaccgctctgggaaaagcgttatttgacccagtcacgcagggtaaacgttagcgtgtgaacatcgttcttcagcgtcagcgtctctttggtcagggtgatctggctccagtcggtcaaggtttgtgacacggcttgctccgtatccatggcatcaccaatgcacattttcatggtcatgcccattttctcaatgcggaattggttatctttgagttcagccttaccaaagaagttattacagccggcattcccgctggccatcatctgttcaccgatctccaaacgtggtgcttgttcgtgttcgcttttcaccacatctttgccatcaatttgagtcagttgccaattatggtgttgaagatcttgagcggtaatctgcacggcatcaccattgcttgcacaagcggtcatcaatacaggaagggtgattgcggcaagtaatgattttgaactaagcttcatattattcactccgaatgtggaaacccgcacagtatagtgaataaaacactgtttttgtcagcataaggtcatggtttatatgaaactttgaacctagtcgctttataagccactacgaagccagtagaaaaggatgtgattcacctatggagcaattggagtttttcaatattgtcagcccttgcattggggtatgcagtgtcgatgagaaaggctattgcaaaggttgtttacgtaagcgtgaggagcgttttgagtggctgagcatgactcctgcgcagcaattacatgtgattaaactctgtcggcaacgttatcgccgtaaacagctggaggcgcgtggtcagagcaaaacggaaaatctgagcgagagtacagtaccgccgactgacgctcagcagactctgttttgacctgtctattcagaccacaaatcactgacccaacctcctacttgatcatcgaaatggttgcccgcaaatttacgcggttcattagcactcggatcttttacttgggtcatcatttcataaatgtagcgagccatgggatcgctgcagctttctacttgttgcttacgagtggcgacctctcttatcagctttagacgataactcttgctattgcgtttcattggcaaacctccaattgttgagcgactgagtttaaaagttagaactcagtcacactatcgtcaatggtcatttgccgtacattttctaatgctattcttgcgctctatttcgctatctcgttcatatttttcggtgctatcactctgtttgccccaatagagggctaatcgagcgattttttaaagcgcagcgcagccagcatcaatccaaagagagtaaagagcgcgagccagagcgtatcgcgccacaagtcagctaaatctgccccacgtaatacaatgccacggatcaaacgcataaagtgagtcgcggggagcagttcagagagccattgtgctgcggtaggcattccttcatacggaaacatgaatccggagaggagaatggaaggaagtagaataaatactgtcatctgcatggcttggagctgggtgttggcgatggtggaaatgactaaacccaaggtcaaactggcagaaatgaagagtaaagtgccgaagagaatttggcttaacgcgccattaatcggaacggcaaaaataaaatgccctaaaccaagaataatcgccacttggatcaaaccaacaaaaatgtacgggacgatttttcctatcatcaactcaatggaatggacaggagtggtgatcaaaagctccaaattgcctcgttcgcgctcacgcacaattgctgcactggtaaacaagatcatggtcatggttaagataaccccgagtaatccgggaacgatattcaccgcagaacggcggctggggttgtaaagtaaagtgatttcaaaagtgggcgttaaaggttggatgccgagggttggaagatcggtaagcggcatattttttagccctaacagcgcgcctgcgatcatggtatctgaaccatcaatcaaccattgccctaattcacgttgttgttggctgcgtgcgaccagatcgctcggcaagatcagcgctgcgcgaatatcaccactggcaatcgctttttccgcctcattaaccgtgagatagtgctgcttgacgcggatcacttgagtgactttgacggattccacaagtaaccgactgaatgaggagtcgctttgatccaccacgccaatcggtatattgcgcacatcggtattaatcgcaaaaccaaatagtaagagttgaatgagtgggatcatcacaaccatgccaaaagtaatgcgatcgcgtgataactgacgaaactccttcaccaagaccgctttaatgcgaaacaggctgttcattgtcgccccttacctgtgacggtaacaaagacatcttccaagctcggccgggcaagggttaattctgcggcggccaattgaggaaaggtatggcgaagccataggatagggtcaataacgtcacgatggactagtacgcgtaagcgaatgccgagctgtgcagctgagcgaacttgcgaaaaattgagcaacttctcttttagactccgcagcgccggagcttttatttccaccacatttacccccatctgctgcatcaatttttcaggctcatcgtcagcgcgaatttcccccgcttccataatggccaaacggtggcagcgctcagcttcatccatatagtgcgtggtaaccagaatcgtggtgccttgcgcggaaaggtcaaacaattgctcccaaaactcacggcggttctcaggatcaaccgcagacgtgggctcatcaagaaacagtaactcagggttatgcatcgttgcagcggctaatgccaaacgctgtttttgtccaccactcatgcctgaaacacgctgcttacgtcgttcatctaaaccataagttttgagttgcgcttgggtgcgctgttgtaatgtactgcgattcataccgaaaatctggccaataaactgcaaattttcttgcaccgtaaggtcgtcatacaatgagaatttctgcgtcatatagccaattttcaaacgcagcagttcggattgcttgggaatcgagagcccaagtaccttgatctgcccagcggtaggctgcagcaaaccagttaacacgcgaatcgtggtcgatttaccgcagccattcggccctaaaaagccatagatgctgccgcgttctacttttaagttaatgttttctatagcggtaaagtgcccaaattgtttgacgacattttcggcatggatggcgtaatcgctcattgcggctccttacggcaaatcgacttgggcgggcaaacccgatggcagatccatcgcactctcaggcagatccacttcggccaaatacatcaaacgtgagcgctctttttctgttaacgcatagtaaggagtaaaagaaggctcattcgcgacccagcgaattttgccttgatattgatctttgatgccgtccacatgcacggtcaccgtttggccaaccacaaacgctgcgcggtgagttgcgggcacataaacccgcgcgtacggtaagcggtcggcttgcacaatcgcgaccacagcattgttcgctacgcgttcaccaagatggtaagggagactatcgagaatgccatcgcgggtggcaaggatagtcagttcatcgagtttttgttgttgcaaggtgacattggcttgggctacggccagttcggctttggcttgttctatgtcttcgattcgagctccagcggtcaatttagtgaattcttcatgtgctgacgccagctctgcttgcgcagaatcacgcgccgagcgtgcagcatccacttccgattgactgatcaactgttttgccaccaactctgctttacggtttagtgtcaattcagcttctttgtgttgcgcccgtgctttcgcgacgcgagcttgggcaacggcgatgtcttcggggcgctcgccgttcgtcagtttattcaatgaggcctgagctttggcttgttgtgccaatgcttgagtcaatagggtcgtttggatctggctgtcgagcttgactagcacatcaccgactttaacgtgctcgccttctgcgatggggagttcacgaatgatttcgttactggttgcgctgaaagtgatgcgatcgcgctctagggttcctaatgcttgaggtgggttttctgcactacaagcactgagcagcaacgccagtaggcttgctattgagagagattgaatcatgtgtccaccgccattgtgctcaataacctacatctaagtgtatgttgtgataaaggattgttgcactgattattggccaactctgtgacaggttgaactggatttattcatcagaaatgaggcagtgtggaatttggctcccagctgggagccaatagcgcaggaaatttagcgaagtaaactgtagagcagagcagaaacggcgagcaatccaaccagtaacacgaagaaagtgctgaaacgtttttgatgttcacgcagggcgggcactttgaagacggcaatcatcggcattatgaatagaatcattgcgatgactggaccagaaagcgcttccatcatgcccaaaatgcttgggttgaggattgcagcgatccagatggtgacaaataaaaagccgatggtgagacgttccgccaaacgtagtgatacccctaagtttttggtcagtaggccagataaactttcacgcgcccctaagaagtggccgaggaaggaagaggtgatggcgatgaaggcgaccagaggcccgagcgtcgcgataaatgggttgtcagtgacattggccagataagtcagcaccgaaatgttttgtgctttggcttcttgcagtgcttgtggcgaaagggcaagtacacaagagaagacaaacaacaacacaaacaaaattaagaccacgctagtgtggcgcagaatctgctcagacttttgatcagcttgttcaccataatgacgacgctggatattggcaaaacttgaaatggccgcagcatggctgaatgagaacaccactaccggtacggccagccatacagtgtgcagaaaatcgctggtttgcggaaaatcaaacgaaggcattgaccagtaagggatcaaatacagcgagagtagggcaaggatcgccgccagcggataaaccatgatggcaaaagcgcgcagcatgattttctcgccactgagcatgatagcgataagcccaaacactaaagcaccagaaagtagtgcgcgtggcggcgataccatgtccgcttggttaaccaagaaactatcgactgtgttggtaaggccaacaccgtagataagcagaataggaaaaatcgataaaaaatagagtagggaaatcaatcgtccagcattttggccaaagtgctcttcgaccacatcagtaaaatcggcatttgggcgacgtgatgaaagtacaaaacgcgccagtccacggtgggacagataggtcataggaaaggctaatactgccatcagcaccagcggccagaatccccctaagccaatattgatcggtaaaaataaaatccctgcacctactgctgtaccaaataggcttagtaaccaataggtatcatgttgagtccattttgaggaacgggcagcactaaaatgggtcacttcctgagagtctttcactgaaatctcacttctctaaaaataataatgtggcgaatcctactcctattagtggttatgatcattttgcgatactggtcataatcactggaattttccgtatgtgcttagtttgcaaactatgaaaaattgaaaaactcaggttattaatctaagtttgtggtttttatttgaaactaaatactaaaattttatgctttttagtaaatttgattgttcgctcgatttttgctcaatgataggtgagtcgatgcctaaagggaatcgacgctggtatgcggcacgcttttcgcgcacaatcgctgtcataactcttcttatcaatcttatgaaccatgcgtactcgttttcctgctgaattgctgcttgttgtgaccaccttattagctgcgggaggctgggttttctcgaagcaagcgattcaagaattgcccccgtttggctttattggcttacgctttatcgcggcctcgctttgtttgttgccattttgcttgaatgcgttgaaacaagcctcacggcaagcgtgttttcaatcgatgggggtcggggttttactcgccgcgtcacttttttgttggatccacgccatttcaatcagtgataccttgggtgagggcgcgtttatcatgagcctctctatgttgtttgtgccgctattggcatggccgattttcggacagcgaccgattcgtgccttttggctttcactgcccgtggcggtcgtggggctcttcttgttggcatggaatggcacttggcaatttgccgcgaatcagttgtggtttttagcggcctcatgttgtttggcgctgcactttaacttcaatagccgtttctcaagccagcttccgcctatgttattgacgaccttacaattgtttactgcaggctgtttgggtatcacgttatcttggttaactgaaagttggcctgcgaccatcagtccagtgacctggaagtggtttgcattgagtgtgttactggccactagcttgcgttatttaatgcaaaccatgggacaaaagagtgctaatccgacgaatgcggcgctactgatgctgttggagccggtgtggacgttagtgttaagtgtggtgatttaccaagaaaccatgccatttaacaaaatgttgggctgtggatttctgttagcctctttgctgttgtatcgagtcagcttgctgcgtttgcgataactacggagcaaagcaaaaggcctcatataacaccgccagcatgacgctggcggtgttcgttatccattcaatctaatacggattaagccaattcaggcaagatcagtttggcgatttcaaagtagatgataaggccagtaccatcgactaaggttgcgatgaacggtgcggagactaccgctgggtcgacattcatacggcgcagtaccataggaatgaccgatgataccagcgcgctccatagcactatcgccagaatcgttagcatcaccaccaaaccgatttcagggccgacacccagcgtccaagcacggatccacgccgccattgccatcgccagcgcaaccagtgtgctggttgacaattctttgcgaagtacggtgccaagattgcgtaaactcacttcaccgacagccatggcgcgcactatggtggtggtaatttgcgtaccactattaccaccagtaccgatgagtagcggaataaagaaggcgagggcgatcgccgcttccaactgctcctcaaaagagcgtaaaaccgtgcccgtgtaggcttccgccacaaacagtaccagaagccagacaatgcgttttttccacaattgccaaggtgacgtttgtagatagctcgcatcaagtggcatggagccaccttgcatttcagcatcttccgtggtttctttttctaagatactgaccgcttcttccagatggaaaaaaccgactaactgctgctgatgtacgacgggcagcaccgataggttatgctcaagcagcagacgcgccgcttgttcttggtcaagatcggcatcgagagtcagacattgtggctcaataaggtcactcaacgcttgatcggaatgcgccatcagcagcgctttaggatcaatcgccccaagtagcaaaccatgttgattgacgacgtaaagacgatggcgcgcttgtgaatcgccccaagattcatacagcacctctttcgcttcaaccacagtttgtgattcaagcagagccagacgctgcgtatgcatatgtgcggcaacgctctcttctccccagcgcagacgttcacgataacgctccgcattgatcggattcatcatgttgaaaacgccatgcagctcatcttcatttaagctacgtaaggctttttcgacaacgcgaggattggcgtaagccaagccaagattgagggcgttgctatccataacacacaataaatgacctgcacggggaggagatagcaacaggatcagttcagccagttgttcaccagtgagctgttgtaaaacaaaatgaatttcttgttcggtgagtttgaacagtttttccacccacttatcgcgacgtgaagagtgcgcgagtttgcgagcaaattcattgagttgtttcagttgtgcagccgcaacaacagagtggtttgttttcattacattcatcacacatacctcatgtgactcaggacagacctgaattgtttgaactttgatgcaagaaaacagcagtaattggacgagcgaaaaggaaatggtatgaaaaagacttcatccccgagtcccagcttcagcactgcacaacgtattcgctcacgcgaaagccacttgggttaacaccttaatccgatgaaaactgtcctgatcttgggcatctctggatgtcgtgagatcagtggcctatgtttgtacaggagcctcgcctaacgagatgctgtaattacacagtatatttccctttgacaaaaaataggcttgaaggccatgactccctcatcaaaaggattttaatgctcaacagcttgagcggcggggattataggtgcgatagttttgccagtgcaagccgaaatgtggtgaaaaatgtaatagttacgtaaagttttggtcagaaccatgcatttgcatgatattgcttggggttgaataaaataatattcatctcactaattttcttctgtaggaattttctctcaaaaagatcacaacaacagaataggaggatttatttacgctaaagctattaataacgttgcctattttatctttattacattattatttatctataagtgtgatctctgccatgggtctgtgacgattgaaacgatatttctttacattactgttaagtgtttttgcattatttgtgcgtgctgcggattatttggatccgaatgagcaagcgtatgtagagcaaaaatctacagtcaccattgcagtattaaaagaaatctggatgccttactggggtgggacaggtcaggagccgatagggattgagcatgattttgcctcagggatagccaaagagctcgggatcaacattgagtacaaaggctttgataccattgaagccttacttaacgccgtcagcacgggtaaagcggatatggctatagggtttgggcaaacccttgcgcgtgaaggaaagttcctattttctaagcctttatatgagaatgtacgcgttatttggttacgcgataaagccatggaagaaaaaccctttgccagtttaaaatgggtctgtattcaaggcacatcctattgtgaaattctcaaagatcgtggttatcccaatattattatggctcgtaactacagcagctctgtggaaatgattcgtcaagggattgcggatgcgacggtgacaaattatgtgtccttaaatcactatttaagccaaaagcgtttagcattgggtaaagtgatttttgatccagacttgggcgtacaaacaaaccgtatattgatcaataacaatgagcctttgttattgtcagcaatcaataaagttattgacgctgacaaacagggactgacggagaataaattaaattcggcagatgtttatttcctaaatgatcaagcgaatttaaatattttacgaaatgaaaatgttaatccagtcgttcgctatacaattcaagacgatttatttccgatgtcatattgggatgaaaaagagaaaaaatacaaaggttatgtacatgatttattagaaagaatcagtactaagagtattcttaaattcgagtttgttcctgcctacggccgagatgtagaagatatgctgcgtcatggcaaagtggatcttatccctagttttaatatgacttatgtcgatgaccgatatttcatccatacaggcagatacacggatatccaatttggctatatagaaacaactcggccttataccaccccaattactggcattcttgatcgcacaggcaagtttaacgcttatattgcggtacaaaagaatttatctgatgtgaaagtataccgcagcatgtatgaccttgagcaagcgttagagaagggggatattacgcatgggcttcttaataaagtactgattaatcagatgttgttggatggtcatcaagacgctttcaaactctccccattgaccgaggggcaagatcttcgagccgatatgacgatgcttgtacgtaaagatgcccgaggtttacaaaacatgctgcaaaaggtgttagccaccttcagccaacaagagattgatgaaatcaaaggtgcctatgaccgcgtcacagtctattttggctatgacaaacagaaagtcctgatatatgccttaatcatattgtgtgctttattaagtatcggacttatcctcaccttatcgctcagtcgtttacgcggtaaattacgcagctccgaacaagttgccaagttatctactgagcagctacgttggttgacggaattactggacgccattccgagcatgatatttatttcggatgcaaaaggtgaggttgtgttaaccaatgcggcttatcggaaaatttatcacacctgctgtgaaaaagggtgtgttcaaccgcagcctgagtgttcatttcttgcgcttccagaccaacatgaagcggaattctcgatcattattcaagctccaaaatctaattgctctatcggcgaacactattttcatgtgacacgccgtgccatttctcacccgattaatcaacgtaagtactatttaacgctgttcaacgatattacggaattaaaagaaactgagcaggctttgcgtcaatccaatgagcaagcgttacaggcggtagaagcgcgaaatcatttcttggcagtcgtcagtcatgagttacgtaccccgattgcggcgatgctgggactgatggagattttggcttcacgtttaaaaagcagcgaaagccaactgctgttgaccaatgcgataagctcggcagagcgtttgaaattacacgttaacgatattttggatttctcaaagatagaggcgcagcagttacagctggatattgggctgtacaatttagccgatgaacttgggccgttattgcgtggatttgaagccagtgcccagctcaaagagattgagtttgatgtgatttggtcgccgaattcgttactgcttgcgaacttcgatgccttgcgttttaaccagatcgtgaccaatcttctttctaatgcgatcaaatttactgaccaaggacgagtggtttttaaaatcgacgttgcccctgagatgttaactatcgtggtcgaagataccggttgcggtatgactcaaacgcaaatcgagtcgctgtttgttccttttgcacaagctgacagcacaatcactcgtcgctttggtggaacaggcttaggtatgtcgattgtcgccaacctgattgaactgatgaatggcaagattgaggtgaagagtgagtttgagcaagggacgcaaatccaagtgaacttgcctcttgtgacgcaaacttgtgatgagtttcgtgggcaagtcgttgctatgtcttatcgctccccttatatgctgtgggcaaaagcgctgggaatgcgagtggaagagaatgaagagtgggtcgagcagagtggccacaatatttatccagatttgctgctcaataggctcagagaggtctccaatctgactcaggctcaaactgagcctgcccattctcgtttgctacaaggtcacgtattagtggccgatgatgatgcgattaaccgtttattgatcaaaaaacagctcagtgagcttggtttgagtgccaccttggtgagtgatggattgcaagctttcgaaaagctctcgcaacatcctgagcagtatgatttgttgattactgactgccatatgccacatcttgatgggtttgctttaacgcgaaaagtgaagcaagagatatccctatttaaaggcgcagttgtgggttgtactgcagaagattcgcgcctagcagcggaacaagctctgcaagcgggtatggataaggtgatttacaaaccttataccttagccaatttgcgcaaagtactcagtcgttatctcacaacacaatgggtcgcactgcctgaacaatcttggcttgacgcttaccaagaagaggaacgcgaggagatggcaatggtagtggctgagtcacttgctcaagatatcgctttactcaatcagccagactgtgatgtcaaagcactggcacatcgaatcaaaggggcagccggctcccttcaactacagcggttagccgatttggctaaaaccgttgagaaacaaaacgatccacaacaacttgtggccgataagcagcaactgatcaatgccatgcatgaagtggtcgagcaggcacaacagtggcttcatcagtatcagagcgaataacgttatgaaaataatgatagtagaagatgatcgaattcaggcgactagcctgaagctcaagctaagacagcttgggttggatgacgtcatcttggctgaaaacggatttgctgccttagaactgtgtaacaaagtgggtatcgatttgatgttttgcgatattcgaatgccgcagatggatgggatcagtttgttatcacaactgagtttacaggcacctaagctaggtgtggtgatattcagcgctgtggaagatacgattcttgagttaacccacaacatgtgtagtttggctggatttgcttatgttgatcgcctacctaagccctacgaagtggaggatttacagcgtgttgtcgaggggtttcaaaagcaaacggagcccgaaaccagtcacaaacctgcaatcacgctaacctgtgacgagattgaacaagcttttctgcacgaccatatttttaattactatcaaccacagtttgattttcgcagtggggcgatggtcggcgttgaagcgctagtacgttacgagcacccaactcatggcatgttaagcccagcagtgtttctgcctttaattgagcagtgtggcttgcatgagaaactcttccttaccgtattagaaaagtcggtctctgcactggccagtattggtgctgacttgcagctttccgtcaacatcagccagcgcaacttgcaacactcaatctgtgatcccattctcgccatctgtgagcggtatggttttcccgcaagcaaactgactctagagatgacggagcatgaggtgtacaacggaaccccgacctcattggccaaccttgctcgactgcgaatgtatggcgttgggctatcgattgatgattttggtacgggttacgcgtcattaggtcaactggctcaactgccttttacggaactcaagattgatcgcagctttgtgcatgacttggcaaccaactacaaacaccaacaattgaccaatatgtgtttgttgctggctcaatctttggggttgcactgcgtcgtcgaaggggtagagaacgaagaaacatggcaatacttgcgtcaacttggggtagatacttgccaaggttactacgccgctaagcccatgccgattgctcagttgagcgaactttacactaaaaatcgtcgtcagtgtttaggttgtcaaagcatggatgatggctggcaaatcttgctggtggataaccatatgctcagcgccacggcattacaaaaagtgctcaataaagaagagaacgtcagcaaggtgtttgtggcgcaagatattgagcagacgctgcacaaactgcgcgatttaccgatcaacctgctggtcgtcgaaagtcggtttttatcgacaatcagtcctgcggcatttcacgagttgcttgagccttactatcgaggggcgctcttggtgctgcatgatggattaaccgctgaagctcaagaggatgagcccaaagccatcgtcgtcaaagcgaatactttgatggaaaccagctcccggatcttactgcaagcgcagcagagcaatgtgcgcccacaggcgcaacaagaagagcttgctcagctttctgagcgagagttgacggttgcgaaaatgttagttgaaggtctaacgaataaagaaatcgccttacaactcgatatcaaccaaaaaacagtaagcacttacaagactaggattatgaccaagttagggattaaatcggccatggaattggtgcgttttgtaacattaaaatagtaccgagagttatggctgtacctacttttgctgaattaaaagttttaatcatcgacgatgcgccgatagtcattgccagtttacgcagcatgttgctcaagctgggtttcactgagccaaacatagtgtggagtaaaagcccacgagccgcggtattcatggccggaaggcagagatttgatatttttatttgcgattacaacttcggtaaggggttgaatggtaagcaagtttttgaggagctaaaacactataaactcatcaagcaagacgcggtatttgtattagttacaggtgagaattcggcgtatgtcgtgcattcgattctggagctcaaaccggatgagtatatcctaaaacccttcaatatcatgaccttgcaggagcgtttaactaacgctatctcacgcaaacatgcgctcaaagccctctatcaagcagaacgcgatggcgatgctgaattaggtctgagtttgtgtgacgagctggagcctttttacaacgattactatttcgtgatccaaaaatttcgtggggaatttttaactcagttgcgccgttttgatcacgcgcgcgaagtctacctcgaaacgttagagcataaagactttgattgggcaaaaattggtcttgcgaatgccctcaagcagaccgggcgtcaagtcgaagccacacaagtgatacaagaactgctggcgagtgctcccaataatgtgcgagctcgggtggaagcggcgagcatcagtctatgcaataactcaattcctgaagccattcaccatttacaggttgccaaccaaattgtccccggacattcagagcgtgaatgggtactggcgaatctgtgcttatcggttggggatggagcctctgctctcgagcgctatcgcttgtatgtggaaattaacaaagagacttatcgtaacaatcatcagatgcacctcaattttattcgtactttgctttatgccgcccgacaagcggaatcggaacagcgtgatctgtgggtgcaagaggcgaaatccattctgaaagggctttacgataaaggccagcatgaagatctgcttgcccaactcgaattagtggctgcgcatttagcgatggaagagggtgaatttggggtttcagtggaaattttaaacaagatttatcgcgctaaaccgttcgaattgtttgaagaccgctaccattttacgtggctactcaatgtgatggggtttgactctgaatttgccaaatgcatcagttggtgtaatgaaaccctgttaaatcaagaaacagacatcgttttagaaagtaaagtggctttagctaaggcattaaaagaagctaatcaagagaagctgcaatggcttgaacaacgctatcacgcactttgtaataaacagcagaccatcgactcgctgcttgcgatttacatcgaaattttagaaaagtgcccgacattgcgtactgtatgtatgaaagtggtgacgatattttctcgctactggccgacggcattaacggaatcggaagcagaacgcttgctgaaaagttgtcatcgcaccatccgacaactgatgaatgaagaagagttacagcaagctcaatacgcggagttgtatcgaaaagcactcacttttcgtagtcgctatcgtttacagcgaaccgaatcagttgaggcgtaaccgccctctacagaggacgattacgccgtatcatcagtcgaaataggccaccatttcgaccgtgtcgccgagttgttgtgcgtttaacgaaaagtgcacatagccttcttgtgtcacaggaatacgcaaatactcatgactgcccgcaccagttgaggcgtgctcaaactgctctcgagttggccaatacgcttttgctgcaaacagatcgacattgcctcggttttgttctgaagcggtgagccatacttgtacttcactgacgccttttggcacgtagatggcgacgtaacgttgtcgatgcacggtaaggctttgactgttacccgcttctaaaagcacaggagcaagatcatctttgatagtcggttgctcattaggctgttcagtgactaggtgtgtgttgaggatgactgctgagtaatccgcacgtcctgtcacacttaaatagtagcgtccgggtttgatgtaaccattctgctcaggtttgaaggtaatttgctcgttgctgccataggtaaattccgttacctgataatcatagtaatgggcaacctgctggtagctcatgtacagatcggcatctccctccccggagatctgaacgtggaactctcggctgtactctggcacatccacatagaacagatgctcgctgtacgcctttcctgtcagtgttaaggacgaattggccgctaactgagtgaccgcattgggttctgggttaggctggtttctggattatctggattatctggattatctggattatctggattatctggattatcgcgttgcaatgtatccagccacgccgaaaactcggtgttatagcgttcacccagtaatttgacactctgtgcccactgatcaaactgcccagtacgagagagtgccagcaagctttccacgtcttgtggatgcttttccaacataaagcgtaccgctaagtagccccagcgataaatgcggttcgtatcattcgagtaggtggtggcaaacacatcagaaaggctcaatttaccttgagaaatcagcttaaccgccgcttggtagccctgcttataatgcatatattccgcgaaaccttctaaccaccacacaatatgaccatgggctaagttatcactgaacgaaccatactggttgaagcgcgcgtccagataatgagtgtactcatgctctaaattgagaatcgacaaatccgcatcattggcataacgataggcgacaaaacgggcttgattgttttgatccgcagggttgccttctaaatactgcccgccattgtcggtggtattgccaaataaaaacgaggagtaattgacatagctgctgttattggcaaacaccaccacctcaacgcgagtgttgtaatcatcagcgaccggtgccaatcccgtatttgccacttggtgaaaatcttgctcttttttatccaatacgtcacaggcttgcgcggcttgcgcatcggaaagatcttgcgagcgaataatggcagggccttggcattcaaagcggtttggcaaaatgcgcgcggctaaatcgcgcttcgctgcatcaagatcgataccgagctgttgcagcacctcaggtgcgtaataatgcaacatctcaacggcagctaaccacaatttgtcgtgtttactccctaaaggatagcgagcaatcacttgtcgcatcacatgacgagccttttgcttggtaatggcatctgggctaatcaataagcggccagtttcacgcagagcgttgtaaaccaaaaactcagcgtcggtttctaatgcccactcattgtccagagcgaatcgatacaaggtatcaatatgttgagtgttggcggctaagtagcggtaaaactccgagttacccacatggccagacatcgcacggaataagttatttaaaccatcgacccattgtgtatcttgcgccgtttctcgattgaagcggtgcagagctaagatcatcgcatccatagtgagcggtaactgcttaacgttatccaccattaaacttaggctcttcattgcgcccacctgttcacggccttggtcaaaagcatgcggatgacgtaaaaagcggtcgatcgattgagcaaagcgttgactgagtgcttgagaataaggttcacgcccagcgttataacgcacgtaatacgctgcgcgaatgaactcaccatagttttccaagcgacgagcttgctgcgcttcaccagtatagcgagcaatttcagcatcgagcacagtttgtaaatgcgctagagaagcttcgctatagaggttatccaaggttgccgttggtgcgtaaaaccatgagttgtaacaagcttgtgtagccacggcaatttgcgcaggaagatcgcgcgcgggctgtaaatcttgtatctcacaagctgcttgtgaataggaggagtaagaaagaccagcgatgacgcacgcccaagcaatggggtgatgttggatacgttgttgaaaagacactgcaaaacctatttatgatgaatatatttgggctgtggtttataaggtctttcttggtttcaataaaatctgatgcgtatgaattatgaggcttattcaataaatggagtttttattctaatccaatgaatcaaggtcactttttatacatttttctgttgaatggtttagtgataaatcactaataattcgaggatatttagtgtgaaatccgttcatactctgcaatagatagaaatgttctattcacattgctttacattttattttttcatgatatggtaccgttcccatcaatagtctgggtgggagttatcagaggtatctatgaacaaaacatttttatcaggagtggttggaacacttctttttacatcttttcagttcagtgcttctggaacggaatccggagtctctagccgtattattggtggagaacaagcgactgcaggcgaatggccttatatggttgcgctaaccgctcgaaatagtagccacgttttttgtggtggtagttatcttggtggtcgttatgttttgactgctgcgcactgtgtggataaagaagatcctgctaagggggatgtactgctcggtgcttttgacatgaatgatgttaatactgcagagagaattcatgtcagacaaatttatgtgcataatagctatattactgcttcaatgggcaatgatattgctgttcttgaattggaacgggatcccttacctcgaagatctgtgcaaatttcagattcatcggatttcaatgagttgacaaaagattcgccaatgacggtgatcggttttggtaatcgtaaagaagtcgatggtgagaaatccgatcctgcaaccatattacaccaagtacaggtcccctttgttccactcccggaatgtaaaacaaaaggcagtgatcaggacgctaaaaacaattactctcaactaaccaataacgcgttttgtgccggttcgtttggcaaagacgcttgttctggtgacagcggtggccctatcttttttgattccaacaatggtcgaaagcagatgggcgttgttagctggggggatggctgtggtcgagccaatagtcctggtgtttatactaacctcagcgtttttaatgattggttagatgatcagcaactaggtctatcctatcgccaaaaacgagacttaggagtagtaagaccaggttcgtatactcataatttaacttttacgaataacggtaatgctgacatcaacttgggcaatacctttgtttttgttgttggcatttctagaacagacgctgctgcgattgtgaataatagctgtacaggagtgttagcttcaggagcgagttgtgacgttgagtttagctataatattactgaacataaacagagttatgtaaaattgataataggatcaagtacttataagacgggtgctgttcatgcctacctctattttgatgctttggacgctgcgccttcagaaacagtaagctttttagcgaatttacctgtccataatacccacgtgaatgatcacccttggacggttgtcggtaatggtctgcagacttcagctttaccagctggagaagagtctgtaattttgttggaaaacctacctcaaggtagactcaaattccactataaactgtcgtcaagtgaagttctcgatcagctatttgtctacgtgaatgataagtttaagggtaaatactttaacaacacggaaaatctagccacacttgatatgtatggtacgaataacaaggttcgatttgtatacagaagacatagcggtagtactgatgaccaaagtcgagccatattgagccaaataagctacgatccaaaattctttgatctacctccaccgcttgatattcgtatcggtgatagtggcggcggtagcctaggtggggcagccttagctcttctctttggttgtggctggttacgtcgtcgtcaacgcgtctgatctatcgatagccaattttgtttactcaaagccaaccgtgataggttggctttgtcgtttttggcaaatcgttgggagagctagtccgccgaccacacattgcgaatatccggccaaccccagttggtgagcgcaacatcatgtaatacaccgtggaaacgcaaggtttgtctatggtggaaaagaggcgccagccaagattcactgaccagaagtgaagcaatcggctccagttgatcgagatattgaggtaattgcgcttgctcacgtacggcatttaattgctgcatcagccatatcacctcatcttggctggcgcacgcatgcagaatcgggttgctgaataacatagcaaaagcggaagcgtggcggttgtcatccaaattaatgttggtcagtaccaaggtttcatccagctcgcccttgagcgcacgttgattcaattcccgataagtgtaagtgtgaatgcttaatgtaatgccttgagctgcaagcaatctggcaatcgcttgggcacaggtctgtaatgcggtgtagttgtacaaggccaaggtcaactgcgtgggaagcgcaactttcggagctggagatttcaacacagcgcgccagcttggcagcaagttgtgcgcgggttcgacgccaaacatctctccgtgacagcgaatatcttgctcaatcgtgtttggattgagtagctcgctgagtcggtgtgcttgagcttgatccaacggttgcttggctctctggttaaacagcaccattaaacacccatcttcgacgcggctttgctgttgggcggcagaggttaaatgaggcgagtctgatagtgagacttgatgatggctggtcgtattggcttccggctgattagtttcaatgagtgggcgacttaaacgctcctcatcgacttgccaaatggtcacacgatcggtcaaggctcgacagccgtagaattgactgaatgctttgagtttgagtttattgcgggtgtgttcctgaacttcaaaagggccacaacctatcacaggaacaatttgtccttcatgaaattggctgtaattcaattgactgaccggttgaatggcgtatttcacgccagatatcatccctgcaaatcccggatctgggcgctctaagttgaataccacttgaaaaggggttggcgctttaatatcgctaatatgtgccagctctgcacggtgtgtttctagactagagagtttagcaaacaggctgacaatggtattggcatccagcggcgcaccattatgaaaggttaattcgggtcgcagataaaacgtccattgccaagtgtgcggatcataatgccaatgatgcgccagttcggggtgtacatggccattagcatcagagctgaccaaacaactgtagatctgacggatcaaaaaacgctcactacttcgctgaggaagatggggcagcagcggttcaaatggacgcttataagtgagctgaatatgcagccgtccttcttgtaccgtagcaccagacgttttctttaacagtttggcaaaagcgacctcatcgttatctaaaatcgctaatgctcgttcgtatttaccgatctgtactcgtttggccgccagttgctccttgagtggctcaagttctctgtgcagtaataatgaagagcggtgatgtcgtcctgccttcggtgtccaagttaaccaacccaattgattcaaacgcaccagcaaatttcttgcgtgacgaggactcgtaaacagtcgctccgccagttcaggcaaagtggttttaatatcgtgacccacacccaagggagtcagcctagcgtaatagcgcaataaattgagatcagacatggttacctcaacgcttagctcatctgcggctattgtagtgaaaaaaggtggagttaatggtgaaaacctacgggtggtttgttcctcatttctcgacttctcagtgcgaaattcccaattttctgcgtaaaacggtgtaatgcggagcaaagtgatttaaatcgctcacttttttgtttccttaatcaggatgacaataaaagcatcaacacaacaaggagtgcagagtatgttcatatcacccgttaacgaacagacgatggccgcctactatcaacaacggctgcagcaaactcatagtgtgattgagcgaatggcgttggttgcgttatttgagttgctctttactcaaacgccccctgagccagaacagcccaaatcatcaaccccataacgagataaaacccgcagcacttgcactattgctcctgacgcttcccccaagctgatacgcaagtgctgcttctttactacctgcgtagggtgactttgtgagcacatagccaataatgtacagctgagttcgctaaactctttccctcactgaatgaataggagagggtgatggcaatccgtaatgtggtatttgatgttggtaatgtgatcgtaaaatgggcaccacaagacattgcccaactgacgtttggtgagggagaagagagtgccttcatggcaacggctgtatttaaaagtgagttctggcgcgatttgaataaaggaaaatacactgaagcggaagtgaaacgcgcactccatcagcaattaggactttcctctgacactctagaacaactctttttccatattaaaaatacccaagttttgctgcccggaaccttgcaattaatggatgatctcctcaaagcaggttatcgcctctacgcgttgaccgacaatgtgaacgagattgtcgcttacttaaaaaaacaatatggcttttggcccaaatttactggcgcagtagtgtcgagtgagtgtggtttgcttaaacctgatccggcgatttaccagcatctggcagactcccagcgcattctcccgcaagaaagtgtctttatggatgatatgccagccaatgtcgagggggcgcgccaacaaggatttcatgccattcaatttgttgatgcgcaccaagcaagagtgcagctagcgcaaatggggctgcacttttaaaggtcagcactttggctaaaaagatgaatacttgatgtggtaacgtcaagccgtttggttagcgcaatgaatagggcaggtgaaaaacctgccctatgtgtttgtttgtcttgtggctatttcgtcggataaatcgtcaaaggctcaaacgtcgccgttgcattgccgttggctcccggatgatcggtgtattgtgtgtcttgcattagggtataaaacacatcaacgaagtcgtcatcatttacaaggacaccatcgggaatggcctcgataatttttcccgtgatctgcgcaataatcgcgtagccttgcacttcaggatcagggataagtttgagcacctcttccgccactttcaccagttgtttcgctagttctttataatccgtgccatcatcttgctccatgaggatcatgtccgcagcaccccagcgatagcgagtccagtgaatgactacctgattcgggaaataatcttgcttatcgtaatccagataaggcatatcaatcagatcaatggttggtttatcgcggcttggatcaactccagtgactagcgcataaatttcggcacggcctgaaatccaaggttctttgtcatcttgcagacgaattttctttaaaacagtggtggaaatgggcgctgtatcggcggatgcagagcgactcaaagaacgtgtcgatgcttcaattgagctactctcttgcgtagacaattgtgggctttgccccaagcgctgcatttccgcccgcatggcttgcagacccgctttgagttcgacggcgctgtcgttatcaactacaaagacgggaacatctggcaattggtagacatcgagttggtggatttggccatacacatcataagcttcaatgtattgccagctatcatcgttaccactcggctcaaaagcaaacagcggactttgtccttcttgccactctttgagcatcgaagcatcggccaaacgcagttgcagaagttgctctgtaaactggtcaataccttttaaggtgcgcacattcttatctgcagagcgtaactgttggctcatctcagtatttggcgcggattccaccagttcagagactgaaatgctcaagttatctgcactgatttgtgttttgagtgtgtgcgcgtaagcggcatagttttggctgaaggattccgccaattgacgcttttgtgcaacgacggcatccgccttcgcttgcgctgttagtccggtgttgctttgtgtttcttctgattggcagccaaccagtgcaacagtcagaagcactgctatggagagtggtttatgcataggtgaacccttttcttgttgtagtgaatagagccatagctctattgggctcaaactaccacgctttgcacgttacacagagagaaactattcagcagatttatctttgtggctcaagatcaaattctgcaacataagggtgagattgcagcataaagtgctactgtgctcgggtgaatgatttttagagttgtcaaagtttggttaaacgtcgaattatcttctgtttcaagcaattagcatcacgtaacctatttaaggcatttctccccacttgaaggagcagtgttcgcacgttcgctcatcctaatcacatcgtttgagatgttgatgaggatagactcgtttttcgtttcgctgccactccaagtcgttttgggatatgtcaggcattgtaacgcgcgacttcctgttgcatgctctcggcgagtcttgccagctccaaggttgcttcagagctttgttgtgctcccaacgcggtttggttggagatttcgctgatggtgatgatgtttttattgatctcctcagtcaccgcactttgctcctctgacgctgtcgcaatttgcgtgttcatggtcgagatacgatcgacgttagccgtaatttgagacagcgccgtccctgccaaacgtgctttttcaacggcttttgatgctccagaaaccccttgttcaattaaattcgccgaatctcgactgctctgctgtaagcgctgcactgtctgtaggatctgtttcgtcgattcttgggtgcggcttgctaaggttctgacctcatcggcgacgactgcaaatcctcgtccttgttcacccgcgcgagcggcttcgatcgcagcattcagcgccaataaattggtttgctctgaaatactctgaatcacatccacaacactgccaatgtcttctgaatctttggcaagtaactgcatggcggcaagcatcttttgtaaatcgttggatagcccttcaatcatcgcaatattttcctcaacgaccttgcgtccctgcatcgcggcttgttctgcttcttcagaggcttctgcagcaaggcctgcactttgcgcgacttcgtgtacggtggcggtgaactgatggattgcggcagcaatttgctgtgtttgcgactgctgttcgacgatgttttgcttcgtttgcatcgcaacggccgcgttttcctcggcagccgtcgctaaagcagagactgagtggcgattactgctaatgacttcttgaaagctcgttacaattcggttgacgtatttagcaatatccgaaaattcatcgttcccagtgacggggatgcgttgagtgagatcgccagcggcaatatgggtggcagaactggctaagtggtgcactgcattattgactcgcttagcaatcagtagtgctaagctggtagtcactatcaaggcaaaagcacccagtaagctgaccatccagataaattggttaatctcgtgttgagaggcagaaaagttattttttccttcttgggtttgaatgtcgagaaaggcttccgccgcttttttgatctcgttataaagagggttaatgacttggagcagaattaagttagccgcatcgtatttttcagccttgagctgttggagagcgggttcaaatccttgacgagtgacttgatccagcttttctttcaaggtttggatcacggctttttcttgaacatccaatacggtagccaatatttcgttatccacaatacggtgcaaattggtcagcgatgtttggataccttcgacgtgcattgtgatcggatgatcatgcatcagcgcgtatttggaggaagggtcatgctggaaagctaacagcagttggctgcgcgcgctgcctaactcatccaatatgcgtccagcacgaatcgtatgttgcattccttttgtataaagcgattcaatcgaatctgaagcactttgcatgcctgtcaagcctttgaaacccaagaaaagaatggaaaccacgatcagcaccacgatcagtttcaagcgtaggccaacgctatgcagtgagtttgtagtgcccgctattattgtgcgatgagcattgttatgttgattggataccatcatccatcccccgacaaaaagtaaaaagttaatgaaattatactgatttgagtatggtccaaactggataattggattgaatttcataacgttatgatacgtagatcatgatttttatggatgatattcacaaggatgacggtctactgacaatatcagacactgaaaatgaacccactgttataaaatacccattgaatgctcttggtatattgatgttaattatcatcactatccagaacgtatttgagagaaccttaataactggagtggagagatgccaacaaccgatcaagcgatagccattactttgccttctttgattcatcgtataggtagcgataccgttaagcgattgaaactgcaggcacagacttttgattgcgagttaaagcgtattcgtcgctcgcgaaattggcagttattaggtgaagcggcctcgatgcagaaatttgttatccaaatcaagcagaccgaatatcaagttgctgaatatctgattcgacgcgtggaagccggtttaaggctgccgagcgacaagatcgaacccatcgaagtccagctgcagcgtttagttcagcaaaatccgtccataaccttagcggaactcatggcagctacacattgcagcttgatgcaggcgcgagcggctcgttttgctgaggagagctttgagtgacctttttgatgaagtaagattaagtagaatctttgctttatgtgtcgaatataactagtctttaatgagtctataattaaggcatagtcaaatgcatattattcctgtggcgtcagatcccaaaacttgttcatgtggtgtgaatgaaaattcgctagattttgattttactatggcatttcaacctatagtaaattgcagaacgaaagaaatatttggctatgaagctttagtgcgaggtttaaataacgaatcggcttattcggttatttcaagagttaatgaagataatcgctatttatttgatcaaatgtgtagagttaaagcgattgctcttgccgccaagttaggactgaccagtaaattaagtataaactttctccccaacgctatttatgtgccagagcgttgtattcgtactacgttagaggccgcgaaacgttaccagtttccgatcgaaaatattatgttcgaatttaccgaggctgagcgggtagaagatgttaatcacataaaaaggattgtcgaatactataaatctttgggttttcaaacagcaattgatgattttggttctggctattcagggttaaatttattggctgattttcaaaccaatattgtaaaagtggatatggggttgataagaaatatccatgccgatcaggttcgtcagtcgatcatgaaaaactgtttaaagctgtttagtgatttaaatattcaaccgctggctgaaggtgtggagagtcatgctgagtttgcttggttaaaagcggcaggcgttgagttaatgcaaggctattattttgcaaagcccggctttgagagcctaccaagtgtcaatcctgagttcagcgaagcgtgaattgtaaattagattggttctaaaacggtgaaaccccgacagttggtagctatcggggtttcgaatttttagatttctcggttggtaatgccgatgatcttatttatgcaaaaggctggatttaatccgagtaattccttggtagggaattagatacggatgaagtccatgtgctcaacttttggcttgtacgcgtggcgttgaacgtcttgaggcttcactttcacttcttggccgtcgataaccagaacgatagcttcgtaaaactcaggcttgtccatctggttcatcacgtcatcgtggttcagtgagatagaaactggagctgcttcaccaccgtaaacgatcgctgggaagtaaccagtgttacgtaggcggcggctcgcacctttacctagatcagtacgtaatactgcttcgaatttcatagtatttactctcaaattagtaaaaaacagagtgacagggcaatgcgaccttgcccgtgtcgtagagtttccaaacctataggagggtcagaaacgagcgcggatactagcattcattgctctctcgggcaactgaaaatccgtttttgcaccgcatttaatgggatttgacggctttggctgcgcgagtgggttgttttaaggtcagagtggcttttaagccgcctaactgactctctcctaaagccaatgctccacgataactgtgcgccatttcactcacaatattaagcccaagcccagtgccgggcgtggtttcatccaagcgcactccgcgtttgagggctttttcgcggttcgttgcactgatgcctgcgccatcgtcttccacgcagatctgtacccaatcgtcactcagtatttggctgtgtacacgaattaagctgttggcccatttgtagctgttttccagaaggttaccgatcatttcatctaggtcagtcggttcaacggccacttctaagtccgaatccagctcattcaccaaggtgattccacgttcagcgtaaaccttatcaaatgcttgtgaaatagcatcgactcgcgcactgggtgcggttttaaccgaaagaatattggcggaacccgccatacgagcacgccctagatggtagtcaatttgctgctggatctgctcaacagaaggctgtaactggattctgagctgggcatcattcaactgagtgacttcgtttttgagcacagaaagtggtgtttttaatgcgtgggataagttccccgcatggtgtctggctcgctcaagcagctcttggtaatgaaagaggagagcgttgagatcattgactagcggtgaaatctcttgtgggtaatcgccattcaacgcattttgctggccatctcgcaaggctgagagttcgcgctgcattttcgaaagtgggcggagtgaccacgtcacttgtacgccagttaaaacgagtatcccgctgaacaatagagccaaaatcatccacaactctttgctcacgcgctgtagcgtggcttttagcggggcatcatctaagcctatcgtgattgtgatgggttgtgaaaattcgggcagataaaccgtacgctttaatacaattaacgattcctctttcgcgccaagataaatcgtaccgtgaacatgggtttcttcggtcaaaaagcgatcccacaacgagcgtgagcgaagcgtttgatcgcctaaagtggctgaccagtaaaggccactataaggctgggtaaaacggggatccgcaagtcgagtggtgagggttaattgtccttgtggattggcttccaagttggcggtgatctcatccatcgacagttgcaactggttttgcacatcttccagcaaatattgatggatgagatttgggatcaaatagccggcggccaagatcatcgcgcccagccatagtgccgcagcaaggagcaagcgggtttttaggctgagatgacgtaacgcccgagatttaattggcatgcaactgatacccaagaccgcgcacagttttgatcacatccggcgcaattttcttacgaatgcgtccgatgaacacctcaatggtattggaatcgcggtcaaaatcttgcttatagatatgttcgacaagctcagtgcgtgaaatcactttctcagggttatgcatgaaataggcgatcactttatattcgagggcggtgaggctaaccgcttgcccttgccacattactttggaagtgcgcgtatctaaactcaggtcaccgacttgcatcactggggaggcattgccggacgcacggcgcagttgggcgcgaatacgagcaatcaactcaaccatttcaaagggtttggtgaggtaatcgtccgctcctgcattcaaaccttcgacccgttgagtgagggtgtcgcgtgcactcaaaatcaccacaggagtgttgatgttttcgtctcgaatgcctttaagtacggtcaaaccatccaatttcggtaggccgagatcgagtacgatgacgtcccactcttccgcggtggcgcggtataaggcatcgatgccatcttgtgccaattcgggaacccaacctgtttgctctaatgccgagaggatctgctggcctaactgaacatcatcttcaacaactaatattttcatggtctgctcgattattttttgatggcacgaatcacattacgcccgcgaatggacatcagctccaacgtagcggcgttgtattcgacacgaaagacttgattgtcatacaccaatttcagctcataaatccactcatcgtcatcttcgtcaagctcgactttgatcaaacgcccattcaactgctgatcgaccgtggcatagagttctgcaaaaggacgaatcaaccctttttggacggcgcgataaacgtcatcttggtcttcatcaatttcaatttgcgtcccttcacgatacgagccttgttcccagtctcgcaccttgttatcagcgtgagtgggcagtgcaaaccctagcaacaacaataggagtaggaggctggcttgcggtctttgctgcatacgaaaaatctgcatagtcaatacctgaatgttgaatctgttgccgagtataacgagataaaaatgaacagaaagtgaattgtgaaacccccatcgctatggtttaaatgatgaacgtctgctttgggtttgcctagtctcgcctttcccactctctgtctaattttggtttgtctataccaaaactacttggagttgcaggtaggcggcaagagagtgaatccccatgagcatagataaactatgtgattggggtgagcgaacgtagctaataccgctgcagcttcaagtaggaatggtataagctcggtttgataagtgagcgtcggttggggaggcgaactcatcggcaaatactttgtcgcgaatggtccaaaagcggcccgattttcgcgcaatcacaaacaggggtggacgaaaacggtgctgatgatccacgactttggcgggcgttgctgcctcaaaaggccgatgtttgtcagccagatgtggacgtacaaattggtcgtgaaattgctgcttttggcgcggcgtattcagtggccaaaactggtgtacttgcaccgcatcttgcccgtggtaagtcacttgaagctggcttttccctttggcgtctttatgaacttttaggctcatgtcggtacattcaaacaccagcgcatctttaagattgagtgcctctttgagtttcttatcggggtccactaacgtggtgtcacactcatggcagatgcgagcggcgatgtcgttatccgcaccacattcattgcagtatttggcacgaaaacggtagccacaatgctcgcgctcacccgtctcatcatcggtgaaatagccttggcagcggcggccatagtgctcaatcagaaagccgttcgcatcgagcttgccccagaagttattgttaaaaccgcaagcggggcagggaatggtgatgatttcgctgtctgaatcgggtttcggatcgcccacttcaggttgatacagatcgtactgattacccgcatagtcgagcaccaaacagtcggatttgcccgccgcaaggcgtagcccgcggccgacaatttgttgatagagactgaccgattccgttggccttaaaatcgcaatcaaatcgacatgcggcgcatcaaatccggtggtgagtacggaaacattgaccaaaaacttaatctgttgctgtttgaacgcttggataatgcgatcacgctctggcgtcggggtatccccgatcactaaagcagcgtgctcggtaggcagtaaacggtagatctcttcggcgtgacgcacggtcgccgcaaaaatcatcaccccttgtcgcgctttggcaagctcgatgatctgggcaacaatttgcggagtggcgcgttgtgactgctcaatcaccaagtcgagttctgattcacgatagcgccccgtattggctggtttcaactgcgaaaagtcatagctcatgacaggggtatcaatcaattgagcgggggtgagaaaaccttcatccaataaatagtgaatgggtagctcaaaaatacagtcgcggaaaaaacgcggctcttcactgcgcactaaaccacgggtgtgatactggtaaatccatcccatcccgagccgatagggggttgcggtcagtccgagcactttcatgcccggattgagttccagcaaatgggtgatcactttttgataactgctgtttttgtcatcggggacgcggtggcactcatcaatcaccaataaagagaactggttttggaactcagataagttgcgcaccaccgattgcactgaggcaaacaccacttgttgatcggtttctttgcgccccaagcctgcggaaaaaatcgcgccagttaagccatagccttcatatttggcgtggttttgctcaaccaactctttgacatgggccaacaccaatacgcggccacgggcaaggcgcgcaagctctgcgatcactaagctttttcctgcgccggtcgggagcacaatcacggccggggtagagtgctggcgaaaatagtgcacgacggctttcactgagtcggcttgataaggtcgtaacgtatacatccgctgggagttaccgaggttatctgggcaattgacggcttttgcatcgtttgatgtcggccgcaagcaattgcgctgggtaattattgtgtgaggtctgtataatagccgacttccagcagatgaggtaagcatgcgtttagacaaattcctgtgtgatgcgctaggtacaacgcgcaaagaggccactcaacttctcaaaagtggtgaagtgaccgtcgatgatgtggtgcaaaaaagtggtgcattcaaactcaaagagacgtcgtgcgttgagtggcaaggccgtgaaattacgttgcatggtccgcgttacatcatgatgcacaaaccggatggtgtggtctgctcgcatgaggatggttttaaccaaacggcgcttaccttgcttgatgaagttaatattcaagatctgcactttgcaggccgcttggatgtcgataccacaggtttactactgatcactgatgatgggcaatggtcgcaccgagtcacgtcaccaaaacacaagtgcgagaagacctaccgcgtgtggttggctgatcccattcaagctgattacgcagagcaatttaaccgaggtattgaattgcgtggtgaacgtgagctgactttgcccgcgcaactggaggtgatcagtgaaacggaagtgctattgaccatccatgaaggcaagtatcaccaagtgaagcgtatgtttgccgctttaggtaacaaagtcatagggttacatcgtgagcgcattggtcagattaccttagatgaaacccttgaaccgggggaataccgctatttgacggaagaagaagtggcctcaatctggaaataaaccaagatttaggaaatagattgtttctgaattagcactagttaatcgcggcgattattaagatcatatacccaaacaacttggagttgcaggtaggcggcaagtgagtccccctaagcatagagagactatgtgattggggtgaacgaacgtagccaacatcgctgcagcttaagtaggaagggtatagaccgataggacttagcgctgaatctaagcgttaagtcctcccacgttttattgcctcatcaagcaatctctaattcgcatacacttatgggtgtacgcgaaaaactcaatttaactctacggagaagtatgtctgcctcaaccgtgaatacccaacaaacaccgcaaatgagtttgttgctttatattgtgctcggtgcgctcggtgcgttgacaccgctggcgatcgatatgtatttgccagccatgccgaccattgcccgtgatttcggcgttaacgctggtgcggtgcaaattactctaactgcctatacggcaggctttgccattggccaattgctgcatggtccgctggccgatagctttggtcgccgtccggtgatgctgtgcggtatcttcctctttggtattgccgctatggtgagcgcgacgaccaatggtattgaagccttaacctatattcgtgccgcgcaaggttttgcgggtgcggcggcggccgtggtcattcaagcggtggtacgcgatatgtttgaccgcgaagattttgcgcgggcgatgtcgtttgtcactttagtggtgaccttggctcctttggttgcgcctatgattggcgggcacttagcgatttggtttggctggcgttctatcttctgggtgctggcgctgtttgcggcactcgttatcgcgatggtgatgtggaaaatccccgaaacgctgagccctgaaaatcgtcagccgctgcgttttcgtagcaccatgcgcaactattttgatttgtgtaaaaaccctgtagctatggggctgattttctctggcgcattttcgtttgcgggtatgttcgcgtttttgacagccggcgcgtttgtgtacatcgatatttatggtgttagcccagacggtttcggatacctgtttggccttaatattgtcgcgatgattgcgctgaccacgatcaacggccgttttgtcaaaaaaatcggctcacacaacatgctacgcttcgcactctttttacagttgatggcggggattggtctgtttgttagctgggttctggattggggattatggggaaccgtgccattcgtggtgttgtttgtcggtacaatctcaaccattggcagtaactcgatggggttgttgctgagtaaatacccgcgtatggcgggaaccgcatcatcattagcgggcacattgcgttttggtacgggctcaatcattggcgctgtcgtggcagcgttgccgggtactgaaacatggccaatgatatttgtgatggcggcttgttctgtgttatcaggtgccttttactggacgttaggaagaaaagcgtaatggcgaattaccatttagaaattcaaaatgtggtcaatactgcactggcagaattagaggccgaacataaagcgggcaagcttgccaatgcgccagtggctaacaaccattttttagtgcattgggtgacgaaagcgctaaaagcacaacgttttcaccgctgcgtgggtgatgatttaactcagtggcagaaagcggggcgctcaaaagggacagaatcacaactgttaccgacctttcaacgcatctccgcgtattacgcgcatttttttgcagagcaagagcacacaccgatcacggataaacaaatagaagcgtttttggatgagatggagcaagccggttgggaagtttccacctctgagccgttagtcaatgcaggaaaagtgcagatttttactgacggccagaattcattggctctttgctctgtgcagtgtgaagcttgttttgatggtgaacggttagtgaaaccaatgaactggtttgtgcgcggtcaccacgctggctttattgagaaagcctttgcggcgggatttatggtacacaagcaaaccgattacaaatcgaatgtgaaataccatggtgagtacctgattttccccgctaaccaaggtactcagttggcggaaattccgatttcttttcgtgctaactagctcagttagatcagtttgaaaaacggcgctcaaaagcctgactgcaggaaaagctcatcccgtcgcttaatctcggcgggatttttttatgatggcttttaccatgccacgaaagataaacagatgcgctggcatcatggcataccagtacatcaagccgagaaaaccttgtggatgccaccacgccgttacattcaggcgtcgcttatcgcccaaatcatcgatggtaaattccaaacgtcctagccccgggcctttcataccaaacagtaaggacaaaaactgctgcggttggcagcggatcaccttccaagagtcgatataatctcccactgcgagttcagcgccagcgggatagcgacgaatcggtttgccaccaccaaacagcacatccaaccattcacgagtacgccacagaatattggcaaaaaaatacccttgatcgcggcggcctatagtgcggatgactttccacagcgcatggctgcttaactcggtttcgatgctggcccccgcttgcttggggtaataaccaaaacccggttgccaacggacaatggcgtgagggtcaaatccccatacttggctacgcacaaaggttccttcactgctgatcgccgctttgaccgcttctcgataggcgatcaaaggctgtggatagcgtgcttcaatcgcttgggtgtcggcaataaaatcatgtgttaacccttccagcagcgagcgtccaatcgagcttggcaccgatgtcaccataccgagccagcgtgcagccatgcttggagtgagaaagcgcgtcgaccataagcgatagggtttcccagtcaattcacacagaatctgaaactgttcgcgatagctgagaatatcaggcccgccaagctcaaacgtctgatgcatctttggctgctcttcggcaaatttcagtaaataggtgttgagattagccagagcaatcggattggcttgggagtcaacccatttaggcgtaatgagtactggcaagttgtagacaaaatcgcgcatgatttcgaatgcagccgagccagggccgatgataacccccgctctcagctccgttatcgggatccgtgactggcgcagtatctgcccagtagcgtaacgcgcttgtaaatgaggggagcgaccagactccggttgtagcgagcttaaatagatcacatgttgtacttggctatgcgcaagatcgagcgcgtcatttacgttttgtgccaatgaaagctcgtaatcgacaaaatccccaccatgcgccatgccatgaactaagaaaaagaccaaatcataattggggatggtggcgagcgttttctgacgatccgctaaatccagagtgagccgagttaagttgggatgagtgggcaagcgcgcatgcaatgtctcgatatgacgagaggcggccgtggtatggtatcccgcattcagtagcagtggcagcaactgcgcccctacataacctgatgcacctaacactaatacctttttcatccgacggtcctttttaatcgtttgttgtgcttatgcgtgcgtgagtataatagcggctgttttttctgcctactctgtccttaaccttaacaggtaatagggagtcctcacactttggagtgatactgtgtctgttgtctctcaagttttatcccacatgagaggggatttcttccgccgcttgatcgcgattgctctgccgatcacgctacaaaatatcatgttctccagccgcggtttggtcgatgtgctaatgctcggtcaactgggagaggccgaaattgccgcagtaggtgtcgcggcacgagcgacctttgtgactacgatcatgctggtgggcgtgaccacaggcggcgcactgctcacggcgcaatattggggcgcgggcgatcgcaaaggtgtgcgtgaaagtacggcactgacttggttagtctctaacttctttgcctttttcacggtattgctgttcctgtttttcccacagcaaatcatgtcgttaacgaccgattcggagcaagttaatgcgctgggtagtcaatatctgatcatcacctcgttcactatgtttgcggtggcttgtgtcagcagtatggcagtcggacttcgcgcgatgcacaagcccggggtaagcacgtttttcagcggtatcggcattgtgtctaacgtggtactgaactggatcttaattttcggtaaatttggattcccagcgatgggtattcaaggggcggcgattgccaccgtgttgagtggcgcgattgaaattgcttgtttgtacagttacttgtatggcaaaaaacatttgatggcctttggctggcaagacatcaaagcggtaattgattggccgaaaattagccgttttctacgtttgtcattacccaccacctttaactttctgatctgggctgccggtttatttacctaccacgctatcatggggcagacgggggttcaggggcttgctgcgctatccgtcatgactccggttgaatcgatttccctgagtttactgattggcatgtctactgcggcggccgtcttggtgggcaatcaacttggcgcgaaaaactatgaagcggtgtactaccaagcgataggtgtaaccgcatgcagtgtgctggtcggtattgttgtcgcgattggtctgtatctggtgcaaattccggtgcttggtgcgtttacggcgttaacgcctgaaacgcgcgagttatcagaaaaattcatgctgatcttgtgtttaggtatcgtgctgcgttcattcccgatgaccgcgatcgttggcgtgttgcgcgcgggcggcgatgtaaaattctgtctcggccaagacatcgtcgcgcagtggtgtattggtatcccgttagccgcctttgctgcgctagtgttaaaggtcgaaccggagtggatttacctgctgtttttgactgaagaagtggtgaagtggtttggctcactacatcgcatgaaaagcaagaagtggatgaagaatttgattgaaaattagacactcatcgttcgattggtgcaaattaatgcatatagtgtgatctgctagccaaaatactttctccgcttagggttttggtgtagattctgtgtccggtttcattttcggcaatgagtggttcgatgttacagctaatagacctatgcaaaggctatgtagatggtgatgaatttcatcccgttttgcagggagctgagttgacgttgaaccaaggtgatcagctggcgctcatgggcgagagtggctctggtaaaagtactctgctgaacttgatcgctggtctggatagtgctgactcgggggaaatctggtttcccggatttcccatgcatcacacttctgagcatcatcgcacggcatttcgtcgtgacaatattggccaaatcttccagcaatataacttgctacccacactcaacattgccgataacattcgtttctgtcgtcaactgaaaggcttacctgaagatgctggtttgtggcgacaaattctgtcggctctcgatctcatgcctttgctgggtcgctaccctgaagaggtgtctggtggtcaacaacaaagagcggcgattgcgcgcgctttgtatatggaaccgaagattttacttgcggatgagccgaccggcagcttagatgaacgcaatgccgaggcggtaatgcgcttgctcacgactctgactcgtcagctcaattgtgccttgcttttggtgacgcacagtgaaaaagttgcgcagcacatggatggctgtattcgtctgcaaggaggacagctgcatgttatggcccgtagttaaggcgctattgggtcattatcgtcgctatccattacagatttgtctggtctggcttggcttgactctcggtgtctctctattggtgggcgttacagccattaaccatcatgccagacaaagttatgagcatggtgagaagctattttctaatcctttaccctatcgtattcgctccaagcatattgctaataaaattccgcaaggcttatatattcagttacgtcgtgacggttttcagcagtgtgttcctttcgatgattaccgttttagtaccacatcaggtttagatctgattttacaagggattgatcccgtcgctttactctctatcgacaacggcaaacccttagctcaacaaagtggtttgcaactgatgaacccgccatatccggtcatggtgagtcaagagttagccaaactgcaagattggcaagaaggggactacatcgcgctgacggatggttctcagcttggcccgattgtgattgatagacataaccaagtcacgggaatgcgagtagtggccgacctatctttggtccgtatgctcaaaaaaggctctggattgacggtgatcgcgtgtgcggatatgccaccggccaagctcgataaactgaaaaaaagcttgcccaatggcttaacgctcacccgaagtacacgttcagagttggagtctttaacgcaagctttccatctcaacttaaccgcgatgggcatgttggcctttttagtcggtatctttattttctatcaagcgatgtcactgtctatggtgcagcgtcagcctttggtgggcacgctaagacaaattggtgttaatggttggcaactggccaaagcattgctgattgaactgttggtattggtattggtgagttgggtatgcggtaacgtcttgggtttactgcttgccaatcaattaattccatctgtcgcgagcagtttgggttatctgtataacgccaatgtggacttagcgattggttgggattggtcatggagcagttacagtcttttgatggcactattggcggcctttgcttcttgtacatggcctttggtgcgtttgttgcgttctcaacccattcgcttatcggcacgcctgtcattggttcgctttgcggggaaagagtttaagctacaagcgctattggcctgtgctttgtgtgtggcggcggtcgcgatttatcaagccccgaaaagtcagcaatcagggtttgcgattattggcttaatgctgctgagcgttgcgctgtttactccctacattatctggacgttattcaccagcttttcttacacgctgcgctgggtcaaagtgcgttggttttttgccgatgccgccgcgagtatgagttatcgtggtgtcgccacgatggcatttatggtcgctttagcggccaatattggtgttgaaaccatggtcggcagtttccgagataccacagatcgctggctgagccagcgccttgcggccgatatctacctttatccgagtaacagtgtcgcttctcgtatgagccaatggcttggccagcagcccgaagttgacgcggtttggtggcgttgggaaaaagatttcgcatcgcaacaagggccagtacaaatcgtcagtacgggcgcttcggatggtgagctagactcactcacagtcaaactgggcgtgcctaattattggtaccatttgcatcatgcgcggggggtaatgatcagtgaatcgatggcgttgaagctcgggattcgtcccggtgacctgatcgatttaccggaaccgatgggctcggggtgggcggtttttggggtctattacgattacggcaatccttatcatcaagtgatgatgtcccatcaaaactggatgaaagcctttgccggcactggcaacgtggccttggcggttgtgctcaaagaagggctcaccggagaaagcgtcaaaaaacgccttgataccattttcaggctggatgcggatcgtatctttgataacaccaatattcatagccatgcgatgcgggtttttgatcgcacgttttcgattgcgggaacgctgggcaatatcaccttatttatcgccgtctgtggcattttcttctcaactcttgcgggagaaacatcgcgtttacgccatatctctttgttgcgttgccttggtgtgtcaggcaaagagctggtactgatcggcggcatgcagttatttgttttcggcgctatctctttattgattgcactgcctttgggattaactttggccaaattagtgattgatgtggtgatcaaacattcgtttggatggactatgcagttgcaaatggtgccgggagagtatgtgtacacagtggtgtggtctatgatggctttaattttggcgggcgctttgccaattattcgtttggcaagaaaatcaccgatgaaatcactgcgagaggctttgtaaatgcgccgctttcgtttgcgcttgaaaccttgggtatggctcagccttggcgctctgttttttatggtgggctttattggctatgagcaggacgagtatcacagcatgttactgcactcggctgatcctgaacactcgacggtacaggcagtgtttgaacccgttttacccaatcatcccgttcgtttaccgactgattttgcctctcgccctgaatttgaacaagagtggtggaggctatacgcgttgctggaggatgaacaaggcaatccgcttagtgtgcaatggaactttttgcgtttggcgcaggatgagcgtgatacgttaggatggcagacgcctcagctttatttttcttctatcgtgattaatggcaagaaagtgagcctacgcgatcaaaaaatagctcgtggcggcattggtcaagccggaatgggcgatcagccttttcggatgtggattgataactggacttggcgttcattgggcatgggacctttacccggtaatttgcacctcagcaccgatcacttcgccctaaatctgcaactgcgtgcgcttggtccttatgtgttatcgggggatcgcggttatcaggtcaaacaagaactcctttctcttgcgagttaccagtttcaactgccctatatcgcagttcacggcgatttggtggtaagtcctgagctacccgcattgagagtacgcggacacgcttggttgagtaaagagtggggcagtgagttagtcgctaacgatctggagggcacggatagtttcgtcatcccactcaatgataagcagtggttgacggtgaatcgctttcgccaccgtggagtgccagattcagtgtacggcatgctgcataacctcaacggtaagagtgtcgcgttgttgaatcgggatattcaactcgaagcgctttcttcctcttcattgagtaatggaaagcgagtccctctacgttggcggttagcgattcctaagtatcaagtgaatgtatctattgagccattggatcgtgacgcttggcagacattcttaattccgtattgggaagggcgtattaaagtgcttggaagccacaatcagacgggttttatgcagttatcaggctattaatttcctgtgatgattatttagggtttgacaaaaaggcgcgttaagcgcttttttggttatgagaacaagataaaacaatcagttactatttttgatcttggtatgaaactgagactgtctatactcaatttaggtgaaattcgcagtgaaatactcatggattcgaaaaaaccgaagtaaatcctcattacaatcgatttttccattacactaagcctagctacactctggaacattcttttgttaatcaattattaacataatttaagggcaaacctatgtctgacatgattcgagatttcttcaagatggaatctgcggggggcattctgctggtgattgcggcggccattgctatggtcattgccaattcagcaatgggtgaagggtaccaagcatttttacatacctatgtctttggtatgtcggtttcacactggattaatgatggcctaatggcggtgtttttcttattgatcggtttagaggtcaaacgtgaactgctggaaggagcgctgaaatcccgtgaaacagcgattttccctgcgatagcggcggtaggcggtatgctcgctcctgcattaatctatgtagccttcaattttaacgatccggctgccattcaaggttgggcgattcctgcggccaccgatattgcgtttgcgctcgggatcatggcgctactgggtaagcgtgtgcctgtgagtttgaaagtgtttctgctggcgctggcgatcattgatgaccttggcgtagtagtgatcatcgctctgttttacagcagtgatttatcaaccattgcactcactatcggctttatcatgacgggtgtgctgtttatgcttaatgccaagcacgttactaaattgagtatttatttggtggcaggcctcatcctatggatcgccgtattaaagtcgggtgtccacgccacattggctggagtagtgatcggatttgctattccgctgaaaggcaataagggtgagcattcaccgttgaaacaccttgagcatgcactgcatccttatgttgcctttgcgattttacctgtgtttgcttttgccaatgctggtatctcactgcaaggcgtgtcattagcagggcttacttctatgctgccactgggtgtagcactgggtctgttccttggtaaaccactcggcatctttagcttcagttgggctgcggttaaactcggggtagcaaaactgccagaagggatcaacttcaagcatatttttgcagtatcggtactgtgtggcatcggttttactatgtcgatcttcatttcatcactggcctttggtcaagcgaatgaagcttatgatacttatgcgcgcttaggtattttaatggggtcaaccaccgcggcattacttggttattctttactgcgactctctctgccgctcaaaaaagcgtaatcatttcatcaggctttgaacaattctagcctccgcaatgcgggggcttttttgtagtttcacactatgacagtgtgctgagtttgcaactcaattgagaacctagagtgaagttaaagtgcagaaattcttataaccattcatatcaataaggctatgcaaccgatgcgaataattattaaaaacgattgcgcttgactttctttttatgataaggttcgcgccaatctcggactgagcttctgggggacacgcgtggtgaccattcaggctgattgtgacaccacgtagggtaggtatcgacaagtccttttgtcgatagacgggatactcttgctgcggagcggcatgtgaatgggaaacccaacattgaactcacttaacttatacacattaatcagctttgtacttcctttatgccctgttcaacaggacagtagcattactgaaccttgattctctgatttagcaattcgtcatccaagcgacgacccacattccggcttgcctatgcgcaaacgcggagcattttgctattcgccatttccataacctaaaccggaaaggcggaaacgaatcatctcaaggggaaaaaagatgagtacagcctttgaagtcgataaccacatcgcaactctgttttcaactcaagtgccgttgctagacggtctttacgatctcactccagaccaagtgctgcttgatcaagctgcgcatgaatctgaagtgcgttcttatccacgccgtattcctattgccattaagcaagcctatggctgtttggtggaagatacgcgtgggcagattttcttggattgcttagccggtgcaggtactttggtgctcggttataaccatccagaaatcaatcaagcactgaaagcacaactcgactctggtctgccataccaaactctggatattgcaaccgaagcgaaaacccatttcatcaagaccgtgaaaggctttttgcctaaggccttgggtgaagattgtgtgatccagttctgtggcccatcgggtgccgatgcggttgaggctgcaattaagcttgccaagcaaaccacggggcgtaacaccatgtttgccttccgtggtgcctaccacggtatgactaacggtacgatggggatgatgggtaacctcaataccaaagcgcgccgtacgggcttgatgtctgatgtgcactttatgcctttcccgtacagcttacgctgtccgtttggtttagggggtgatgagggtgcgaaagccagtatccgctacatcgaacgtctgctgaatgatgatgaagcggggatcatgaaacctgctgcgatcatcgttgaacccgtacaaggtgagggaggtgttatccctgcgccagcattctggttgcgcgaactgcgccgcatttgtgatgagcacggcatcctgttgatctttgacgaaatccaatgtggtgtaggcaaaacaggccacaactttgcatttgaagagtccggcattattcctgatgtgctttgcttatcaaaagcgatcggcggcggtttacccatgtcgattctggttatcaacaaaaaacacgacacatggcgtccgggcgagcacaccggaaccttccgtggcaaccagcttgcaatggtatctggcgctaaagcgcttgaaatcattcagcgtgataacctcgttgagcatgcgcgtattgcgggtcaatacctacgcgctggcctagaaaaaatccaaagccgagtcaactgtgttgccgaagtacgtggaaaaggcttgatgctcggtcttgagattaaagatccaagcggcgaactgaacaagtttggtgagccaaaatcagcaccacaactgacactggcaattcaacgtgcggcacttgagcgcggcttgatggtagaaaaaggcggccgtgatggctccgtaattcgtttcttgccaccagtcatcatttcgtttgaacagctcgatttcgcgttacgcgtgcttgaagaggcgattcttgcagcaggcggcggcaaaaaagatcctgagcaagttaaccaagagtggaaaaaacactttattcatacgggccacatgggcagccaagagttctcacaagtgatgaaccatacgaccgctgcgatgaaagccgtgtttgaagaggtgaaagcaccctattcaggccttgatcctaaagtgctggaagaagcgatttacgcggtggatctagataacaaaaatgcgtcactaaaagaagttatctctgagaccgcagagttgatcgcgaagaactccatcatggttcaacaccctgactgtatcgcgcatttgcacacgccacccttaatgccttccgttgttgctgaagccattattgcgtcattgaaccaatccatggactcatgggatcaatcttctgcagcaacctttgttgagcagaaagtggtggattggatgtgtgaaaagtatgaactgggcgcgcaagcggacggtattttcaccagcggtggcacgcaaagcaaccagatgggcttaatgctggctcgtgactggatcgccgataagctcagtggccattcaatccagaaattgggtctacctgagtatgcggacaaactgcgtattgtgtgctcgaagaaatctcacttcacggtacaaaaatcggcatcttggatgggcctcggtgagaaagccattcttgctgttgacgctctacctaatggcacgatggatgtgactaagcttgaagctgcggttgaacaagccaaagctgaagggcttattccctttgccattgtgggtaccgcaggcactaccgaccatggtgcgattgatgatctggtgacgatcgccgatgtggctgagaagcacgcactgtggatgcacgtggacagtgcctatggtggcgcactgatcctgagcagtcataaagatcgcctcaatggcatcgagcgcgctcaatccatcagtgtggatttccataagctgtttttccaaaccattagctgtggcgcattgctgctcaaagacaagcataactttaagtatctgctgcaccatgcagattacctaaaccgtgagcacgatacgctgccaaacctagtcgataaatcaatttcgactactaaacgttttgatgccctaaaagtgtttatgaccatgcaaaacgtgggacctaaacaactgggcgccatgtacgatcacctgctcgctcaaacattgcaggtggcagaactggtacgtcagcatcaaagcttcgagcttttagctgagccatctttgtctaccgtgttattccgcgcggtaaatgaacaagctgctgatctggatgaattgaacaaagctgttcgtctacaggcgctggtacgtggtgtcgctgtgcttggtgaaaccatagtggatggcaaaacggccttaaaattcacaatcttgaacccatgcttgacgatgtcggatttcgactctctactggttaaaattgaagctctagctgctgagctagcgaactaaaggtaaaggaactatgtctattctacagattggtgcaggcggtgttggttgggtggtggcgcacaaagccgcacaaaacaacgatgtgctgggtgatattactattgcgtctcgctcgattgcgaagtgtgaaaaaatcattgagtcgattaagggtaaaaacaaccttaaagactcttccaagaaactagaagcgcgtcaggttaacgcggatgatatcgaatcactggtgaaactgattaatgaagtaaaaccagatttagtcattaatgctgggccaccatgggtcaacgtcgccattatggaagcgtgttaccaagcgaaagtttcctatttggacacctccgtttcggtcgatctctgttccaaaggccagcaagtacctgaggcgtatgacgcacaatgggcgtttcgcgacaaatttaagcaagccggtatcaccgcgattttaagtgcaggttttgatccgggtgtagtcagcgtatttgcggcctacgcagcgaaatatctgttcgatgaaatcgacaccattgacgttttagacattaacgctggcgatcacggcaagaagtttgcgacgaactttgaccctgaaaccaacctattggaaattcagggtgactccatctattgggatgcaggggagtggaaacgcgtaccttgccatactcggatgttggagtttgatttccctaaatgtggcaaattcaaagtgtactccatgtcgcatgatgagctgcgttcgctgaaagagttcattcctgccaagcgcattgagttctggatgggttttggtgatcgctacttgaattatttcaatatgatgcgtgatattggcttattgagccctgagcctctgactctgcaagatggaacggttgttaagcccctgcaagtattgaaagcgatgttgcccgaccccacatcgcttgcgccgggatacaaaggtctgacctgcattggtacttgggtacagggcaaaaaagacggtaaagcgcgtagcgttttcatctataaccatgctgatcatgaagtggcttaccatgatgtggagcaccaggcgattgcctatacaacgggtgtgcctgcgattaccgcggcattgcagtttttccgtggtgaatgggcagagccgggtgtattcaatatggagcagcttaatcctgatcctttcctagaaacgatgccatcgatcggtctaggctgggatgtgatggaactggagcccggacagccagatattcaagtggtgaaataatgcacactgagagtgaaaacctcagtgattaactctatacccttcctacttgaagctgcagcggtgttggctacgttcgttcaccccaatcacatagtgtatctatgctcatggggatgaaatcacttgccgcttacctgtaactccaagtagtttgggtataaacagctataaccgaaaggttatggctgtttttccattcttgttatcgagatatttgccatcacaagcatgaatggaaacattgcaggatataggaacaaacatgctaaaagacgaattgagaaccccatacttcatgattgatgaagcaaaactcatcgctaacctagaaattgctaagcacctgaaggagatttcgggtgtgaagatggtgttggcactgaagtgtttctcaacttggggtgtttttgacatcatcaaaccctatctggatggcacaaccagttcgggtccgtttgaagtaaaactaggctatgaaactttcggtggtgaaactcatgcttactcagtaggttacagtgaagaggatgtaaaagaagtcattgatatttgtgacaaaatgatcttcaactcacaatcgcaactggccgcttatcgccatcttgtggaaggcaaagcatcgctaggtttgcgtatcaaccccggcgtcagctatgcaggtcaagaccttgctaatcccgcgcgtcagttttcgcgtttaggggtacaggccgatcatatcgatgaaagtgtcttcgattcgattaatggcgtgatgttccatatgaactgtgaaaataaagacgttgatgcctttattggcttactggatgccatttccgaacgttttggtcgttatctcgataaattagactgggtgagtttaggtgggggcgtcttctttacttggccaggttacgatgttgagaaattgggcgcagcactgaaagcgtttgctgagcgtcacgctgttcagctctatcttgaaccgggtgaggcgatcattaccaaaaccacggatcttgtggtgacagtggtagacattgtggaaaacgggatgaaaaccgcgattgtcgattccgcaacggaagcgcaccgcttagatacgctgatctataaagagcctgcatcggtgttggaagccagtgacaagggacagcacgaatatgttattggctcttgttcttgcttagcgggcgatcagttctgtgtggctaagtttgatgagccgcttcaggtcgggcagaaactgcatatcctggacagcgcgggttacaccatggttaaactcaattggttcaatggcctgaaaatgccgtcggtttattgtgagcgcaaaaatggtcaaatccagaagatcaaccagtttggctatgaggatttcaaacgcaccttatctttatggtcaattgagtagcgagtacatattttgtctggactcgaagcggtgaggttaagcgattaggattactcacccttgatgacgatagccaataaaaaacaacaaaaaagccgtgagtaatcacggctttttgatgtgtgaagatagtgattacataggaagtgtcgtaaaaatcgtccactctttgaccacttcacctttgtagccaacaactgttgcagtaacacgacggttacgagcgtggctcacatcatcggtaccttctacttccaaaacgctatccccgtatccgacaatgttcacgcgctctggcgctacgccataacgcagtaattggtcacgaaccgcttctgaacgctgcttagagagggcaaggttatgttccgcgctgcctactttgctcgcgtagccttgtaactcaatagatgttgaaggataggtttgcaaaaactcagccatttgacggatttgcgttaaaaacgcaggctcaatcgagctcgagtcattagcaaacagaatatgtaattgctgcatctgtgatgatttgacaaaggtgccacagccatcattatcgatttcagagcccttaggtgtatcagggcaaagatcgcgagcattgataacaccgtctctatcgtcatcttgcagatccgcaatctgattcgcgagtggagttggacgatagtcgtactcatcaccttcgtgctttgtatattgaccttgatttgccaatgccgacgtggttacagtgcaaagaaatagtggcagagcccatgatttgattgacatattagtactccaccttagctgtccattcctgcgggatatcgactcttaaggcatctaacaagttaccagatgcattcatgacacgatattttgcatattgttcagcatatcgtgcatcgaggtagtccttgcgtgcctcgaaaagctcattctcagtgttgaggagatcgagcaatgtacgctggccgatttgatactgtttacgatacgaaacaaccgttttggatgcagaatcaacgtgatctgccaaaaactgtttctgttgcagagtgagatccaaggcactccaagataagcgaagcccttcctcaacggtacggaaggttttttcacgcagatccttggaacgattgagttgataagccgcactttctgtacgatcactgtcactgccgccattgtagagattgtaacgcaaacggagcatcgcactgagctcatcactgctgccctcaataccgcctgcatcattacgccagctttgagccgcttcgaaagagagtgtggggtaatttggcgctttagactgcttatactggaagcgtgctgcatccacatccgcttgagcaaccttaatcactggatgattttcttgcgccatatttaaagcattttctaatgtcggcggtatcgcattttgatcggcacgaggaaactctaagctcacaggttcttgacccactaaacggcgaaactgagtgtagatgtcaaaaagattgttttgtgcagccaccaagttgctgtgcgcttttgctaaacgagcctcaacttgagtcacatcggccgtagagccaatccctgaatcggcgcgctttttaatatcgcggtagatatctttatgaatagccagattgttttctgacagcgttagaatttcagaagctttggttgcgtccagataaatcttggcgacttccagagccatgttagaggcatcggctaataactgatagcgatccgcctcagcttccgctgccgttctatccatatcattcagtgtggcagacccatcccaaatcaattgagtgagggtaagggtagcatctttacgagttaaatctgtgtttctattaccactagattctgcaggattaattgcctcataaccgatacctgcatcaagatcgattttcggtaagtaagcgcctgacgatgcctctgcatcatattcacgacttttaaattgattaaatgcgctttttagctccgggttggatgccaacgtgatggatacagcttgctccaacgtttgcgcagaaaccggattgctcaatgcgatagcgagcgcaatcgcctttaatggtaatcctttcaaaacgttctccccagtgtgggccattactcaatgaatgacctttagtctaatccagattcattatcatttataagacatataggatatttgacgtcaacaatatgacgcacgcgagaagcgtatcacatatttacttaaataaacccctgtgaaccagtcataacgatgtaaactaaaagtattaaatcatttcagttgtggatgattttggaataaagttaacacttccaaagtgttgtgatgtgactttagttcaagatttatgttgttgctagatgagacagcataagcggtacgtctgtgatgtaaagatttaaacatgtttttaactaaagttagcgtttatctgaactgattttgtggcgaaggaagagtgtcaattatcaatacactcaaaagtattagggtctgaggctttatatgggaattcatgctttgttgtctttaacaaatctagcagcaaatcagctgctcgtgattgataaaaacggaaatatcgcgatcatcaacgcaggagaggcggttcctgaaggtgcgattatcctcgacccgaatagtaacaatttgatgcctgagcaggagccactgcccgtagcacaactggtggatgctgagggtaacgtccagccgatcaccgacgatatagagcagattttagccgcattagaagaaggcgcagacccgactgcactagatgatctcgccccagcagcaggtggccttcaagggtcatccatcacgggtagcgcctccattgagcgtgatggtgctgaaaccatcgcgtcaacacaatttgatacatccggcttcgaagccattggcctatcaagaacgcaaagcttgagtttgctgaacctactgcaagctcctacggctccaattacccctattccaccagttgatccagaagagcctgcctctcccattgtaattagcagtattacaggcgataacgcagccgaaggtagcaacaataccttttccgtgagcctatcaggtactactgccgcggaaactacaattgtgctgacactggctggtgacactgcgaccaaaggtgtcgatttcaatggtacgtcagttattgtcgttattaatggtgtgagccagacagtgccagttaatgaagatggcaccttccaagtaacagtgccgaccaatacaaacagctttagcgttcaagtctctaccattgatgacaatatctacgaaggaaatgagaccttcaccctaagtggtgcgggcacaaatagcatagtcacaggtacagcgaccatcactgatgatggcagcaacggcggcacagacgacagcccagtagtaaatggcatcagcagcccaaccgtatcagaaggggaaagcgcaacgtttgacgttagcctgagcaacgccagcacaacagcgaccaccgtcactttgacattggcgggtggcagcgcgactgcaggcacagacttcaccagtagcgaagtgaccatcacttatcaagatggcaccacacaaaccgtggccgtcaatggcgatggttctttcgaagtggcgatcccagcgggtgacaccacgttcagtatctcggttcaaaccaccgacgataacgtatatgaagggagcgaaagcttcacactgagcggaaagaccgcgactcaagggacggcgattaccacgaccggaaccatcgtcgacaacgacgaggtaccgaccatcaagtcgatcggcaccggcgatgtgaccgcgaccgaaggcgacgcgctgatcttcacggtgaaactgagcaatgtcagcagcaccagcacgtccttcgacttcctgctgcaagatggcaccgccacgtccgacgactacggtgcggccagcttcagcaacggtgtgacctacgacgccagcaccggcaagatcaccgtgccgactggcgtgaccagcttcaccgtcaacgtacctactaccaacgacagcatcgaggaagccgacgaaaccgtcaagctgaccatcggtggcaaagaggtgatcggcaccatcgtcgataacgacaacgcgccgatcatcgacgacgcgaccgtgaataacttgtcagagagcatcgcgaacggcaccgaagtgtacgacgtacatgaagcgcgcaccggcaacgacaccgacctcgatggtgaagcactgcaatacaccttcgtgcacagcaacaacacccgtagcactactagtgaagacggtgcgttcagcatcgatccaggcaccggtaagatcaccgtgctggataccacgaagttggattacgagagtgccacgtcaatcgtcctgaaagtcgaaacgactgacggcgtgaacaaagacactgcagacatcacactcaacctgactaacgtcaacgacagtgacacggtcttcaccaaagagagtgagacgttcaactatgcggaaggcacggcggcgggtgtaacgctgggcaaagtcacagcgaccgacgccgatggcgacagcatcagttacagcatcgcgcaagagcacaacgtgtacgcggcggatgatgtgaataaagagcgtccgttctaccaggtggatgcgaacggcaatgtgagtctgaccgaggcgggtgagaaagcgttcaccaacgactacgagtctggccgaaacacgcacaccatcacggtgacggcgacgggcacagacggttcgggcgcggacaccacagacaccatcgaggtgacgctgaacgaaaccaacatcgatgacaacgcaccgaagtttgaaggcaccaccgacggtgagtacagcttcagctacgacgaaaacagcgcggcggacaccgtactgggcacggtcaaggccaccgatgcggataaagagacggtgacctacagcatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctgggtggcgtgaagaccaccgacatcacagtcaagctcaacgagcagaacctcgatgacaacgcaccgaagtttgaaggcaccaccgacggtgagtacagcttcagctacgacgaaaacagcgcggcggacaccgtactgggcacggtcaaggccaccgatgcggataaagagacggtgacctacagcatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctggggggcgtgaagaccaccgacatcacagtcaagctcaacgagcagaacctcgatgacaacgcaccgaagtttgaaggcaccaccgacggtgagtacagcttcagctacgacgaaaacagcgcggcggacaccgtactggggcacggtcaaggccaccgatgcggataaagagacggtgacctacagccatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctggggggcgtgaagaccaccgacatcatagtcaagctcaacgagcagaacctcgatgacaacgcaccgaagtttgaaggcaccaccgacggtgagtacagcttcagctacgacgaaaacagcgcggcggacaccgtactgggcacggtcaaggccaccgatgcggataaagagacggtgacctacagcatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctggggggcgtgaagaccaccgacatcacagtcaagctcaacgagcagaacctcgatgacaacgcaccgaagtttgaaggcaccaccgacggtgagtacagcttcagctacgacgaaaacagcgcggcggacaccgtactgggcacggtcaaggccaccgatgcggataaagagacggtgacctacagcatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctggggggcgtgaagaccaccgacatcacagtcaagctcagcgagcagaacctcgatgacaacgcaccgaagtttgaaggcaccaccgacggtgagtacagcttcagctacgacgaaaacagcgcggcggacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccgacatcacagtcaagctcaacgagcagaacctcgatgacaacgcaccgaagtttgaaggcaccaccgacggtgagtacagcttcagctacgacgaaaacagcgcggcggacaccgtactgggcacggtcaaggccaccgatgcggataaagagacggtgacctacagcatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctgggtggcgtgaagaccaccgacatcacagtcaagctcaacgagcagaacctcgatgacaacgcaccgaagtttgaaggcaccaccgacggtgagtacagcttcagctacgacgaaaacagcgcggcggacaccgtactgggcacggtcaaggccaccgatgcggataaagagacggtgacctacagcatcaagtcaggcaacgacaacggctggtttgcgattgatgcgaccacgggcgtgatcaccctgactgcgaaaggtgcagaggcggcggcgaacgactttgaggcgctggccaacgtgcacagcttggtggtgactgcgaccgaagacgcaggtctggggggcgtgaagaccaccgacatcacagtcaagctcaacgagcagaacattgatgaagagcttagtatttcagggttgaatggagctaatgctgagttaactatccatgaatctaatctttcaggtggttcgtcgccagatcactctgctcttagcaaagttgggagtttcagttttacttctattgacggcttagcgtctttagtaatcgcgggtcatagttttaatgtggcagaacttcttgcgttgaattcatctgaagcaacaatttcaacgccttatggtgaactcaccttgacggggttcagtggtgatctcactggtggaacagttcaatacgaatatacgttgaacgaaaatgtggataacgattcagccaccaatgcaaatgacacggactataccgatcatatctctgtgactgtgattgatgtggatggcagccagatcacagatagcttagacgttaaaattgttgatgatgcttctacggctcttgatgaccgtggtgaagtggacattgttgctgacagtttcacggtctctggtgtggttgctaactggacatcatggagtaatggtaccaacgtaaccacgtttgatggaactaatgcaccaaatggtggtggcttagataatgacagtggcaaagaccaaatccgttggggtcaacccgctagctcatacagctctggctacggatttatcgataatgatagtgcgctaaacggtgagtttgccttaaaccaagatattattttgggtacttttactcattacaattatcccgtttattcaggtggtgcgattaccagtgccagtatggatgttgcgttctcagtgacagatgcccacggcgtacttacacctgtaacgttgaaactgaattttgatcacaatgaaacgccaaataccaataatccagaagcctcaaaagacatcattaaagttggtaataccaatgtgacttttgagaatgcaggggctctctataccttgcaagtgattggctttaggattcctggcaccaatcaaattgtgacggaaattagaacgggtgaaaacgcaactaacagctatgaattggttgtacgtgttggacctggtgaggggtatgaattgccatccacatcaggcaacgtattatccaatgatgtttctggggcagatgtcgatatgacggttgtcggagcagcctctggtaatcacgtgagttccggtgtctcaggcagcgttggatctatgattgcgggcctgtatggcaatttgatcctgctcgctgatggtagctacacataccaagtgacagcgaatgcatcttcgattcctaatgatgcaatcgagattttcacttacaccatgaaagatggtgatggtgatacctcaactgcgttactttctatcaatgtgaaccgagttacgatggcggatttcaatgctaaccaagatcacaaggttggtttggaagacaccgtggtggccggtaatgtgttagacaatgatggaagcaaaaatacctcagtggatcatttcacggtaggtaatgatgccacttctcacgtggtgggtagccctgttagcttagagcaaggtgagctgacgcttaattcggatggcagttacacatttaagccagcagataactggaatggtgaagttccggttattacctacacaacccacactggaaaaacgagcacactcgccatcaccatcacccctgttgatgatgcgacggttactcaacctgatcataagtcgattgcagaagatactattgcgacgggtaatgtgctggccaacgattgcgatatagacagcgctctctcagtcaccagcttccatgttgagggagtcaatggtgtttataccgctggtaatacgatgtatcagctggctgaaggtactttagtgcttaaggcaaatggtgattatacctttgatccaaaagataactggagtggctcactaccagaaattacctataccaccaataccggagcaactggaactctgaacattcatgttgaggcggtggctgatgtgccgaacctgactatcaatggctatacctctgttgctgcaatcaatttcgaggatgcgagattgaatggcagttgggatggcgtggttgctaatcagattaaaggtctgaacacgattggaacgtggcataccagcaataatagcggtaaagttgaaatcggttacgaaaatatctatgtctccggtggttcttcaacaaataaagtcatggaaattgagttcaataacggtgacaagacgctgtataccgatattcatgctcaagcgggtcgtttttatgagctagattttgatattgcagctcgtgctggttctgtgaacagttcaggtttaaccattaagcttgttcctctgaatgcttacggtgttcctatccttgccgaggcgatcactctttatgatttcaatccaaccaatgcgaactggttgagagatcaaaaagttacgctccctattgatcaaactggggaatatcgtctgttgtttgaaagcgatgatgctaatagctatggggcgattttagataatttggcgtttaaagttgttgataatatgggctaccgcggagatttcattaaactgagtgaaatttccacttcactgaatgataccgatacctctgaaaccttgagtcttaaattaaaaggaatgccagaagggtcgatcttgaaagacgataaaggtcatgaagttacagtgggttcaaacggtgaggtagatattacaggatgggattacagcagcttacaaattaaaacgccgaaccatggtaatttcaatattactgttgaagctacggcgactgaaagcagtaaccaagatagtgcaacgacgagtgcgacaattccggtcacggtattacatcctaatgagtatttgggacgtggcggtgttgactctttcttgttgaccaaaagcaatggcgataatgctaacttaaatattgctctcaatgcttattatgaaggcaccacagcggtcgcacctgtgacgcaacaagtagcagtaacgattgatacggacttggtgattcattcaggaaatagtaacgattatatcgatttaggtattagtcgcgcggataatacggtttataccggtagctcaattcctaactttaataattccacgccgtcacaatctacactggcggatagcgcgtttatgaaaaatgacgtgattactgatcatgatggtgtgttattacaatcggtacaaagccaaattcagccgatcactgatacggtgaatttaggtagtggtaacgatacagtttatggcggaggtggaaaccttgccgcttatggcggagcgggtaatgacactctgattggcggtgatggcaacgatgcactcagaggtggtgcggataatgactatctttcaggaggtcgtggtaatgacgttttacgtggtgattcaggcaatgacgttcttattggtggtcttggccatgatattttaaccggtggctcaggagaagatctcttcaaatgggttgatggagatctggatggaagtacagatcgaattactgatttccatttatctgagaaggataagattgatttaagtgatttgttcgataatccatcagagcaagaggtgacggcactattggatagcattaaatcaacggtgcagggtgatgatcattcatcgtcattcaaagtagagaaaaatgatggttcttcggtgacaattcaattagatggcgtgtcgtccgttgaacttattaacaacctagcatctataattcagattaaagaagactagcacttgcctttaataaaaatcccgctaactggcgggatttttgtctctggagagaatgaagtctacttcctgttagttggcacgattagccatcaatatgctgatgtgtttagagaaacagataagggaaaagctgttttctttcttgtgcagaaaggctgctgactcttgcaatattggtctctgggatggcttctggatttggatagtgtttcagcactttttccatgctctcttcgcggatcaggtgaaagatcgggtagggtgagcggttggtgaggttctcatcatcctctggatctgtgcctgcaaagcagtaatcaggatgaaacgtcgcgacttgaaacacaccttcccagtcttgttggcgaattaatgcttccacccagtcgatgtaaaaattgtaatcaacaaaatcgtgcagcaggtttgggacaacaacgagcgtggtttcaagctcttgcggctctttcgtatcaagttcaagcaactgatcgtaaatatgttgcagcagtgcttcttcatcacgggcttcactgacatagattttaatttgctgattacgctgtggttttgcggcaaatgggcataagtttaagccgatcacgacctgattaagccaatgatcgacttcttgaataatggtttccgttgacatgttgagctcagattcttcgttttacatttatcatttggcgctgagcatagcacaacttaggccgaagggctggccaaagcctgactgccctgtggcgtttgtttattttgtcggcttaagcgccaaccaaggataaacaagatgaagtaaagccccaacccgccgagtgtgaccatttcccaaccaccgtgttgccaacagtacagcaggtaaaaaccgcctaaactaccgccaatataatagtgaaccaagtaaagtgcagtcgcggtggctttggcttgtgtggctttttgactgacccaagcgtaagccaaagtatgggtgaaaaaggcgccgaagctaatcaaaatcaagccgaccagcatggcgggtatcgcttcaatcaacgcaatcaacatgcctgccatactgatgagtgcgccaagcatcatgccgggaatcgccgagaaacgccggttccagttggcggtgagctttgagctcagtgttccagctaaataacagacgaaaatcagtgaagcaatacctatgggcagtgagtagggttcggcgactaaacgaaatcccatcacggaatagaggttaacaaacagtgcgaagttaacaccgccaatcaacatagctagccagagtgtgcggttttgcagatgtttgactaacgcacgattgtgatggaaaaacagcccacgttgcggtttaaaatgctgttgaatgggcagcaaatacgcgaccaaaagcgcgccgagcagagtaaaaatggccatcgcaacgaccgcatgttgccagccaagggcatcggtgagtaaccctccagcaatgcggccggtaataccgcccaatgagtttgccgcgatatagccaccaatcgccttaccaaacgcttgcggagaaagctcttccaccatgtacgccaccgcaaccgaagcaaaagccgctaaagccacccccattaaagcgcgggtgagcactaaaaaccaaaattgctcagcataaagcatggctaagccaatcacaggcatagcaaataagccggtcagcatcactaagcgtcgcccaacggcttccgaagtgaccgcccaaggcacgagacaaagcgataaggctaaggttgaagctgcaaacaaccagttaatttgggtttccgaaaccgcaaagtgattcgccaaataaggcagcatgggttggaaaagataaagattgcagaaaactaaaaatgagccgaaggcgagggcaaaggtcacttttaaatattggggagaatgcagttcaatcatacagcggatccaagatgcaaaaaggcggtgatgtgatcacgatagcagtggcatctcgattaatgaaatatattaaaaatatggttgcgatatacaggatatatgatggaagttcgacaactgcgtcactttgtgaccgtggcagaatgggaaagttttaccttagccgcgcagcaactgcatattgcgcagcctgcactgagtatttcgattaagaaatttgagcagcagctcggtgttactctgtttaaaagagatgaaagaaaagttgcgctgacccatgaaggtgaagtgttgcttgaacatgccaagcgcattttgcaacaagtcaatgatgcccaattggcggttgatgagctcaaaggtgttgtgaaaggcgaagtacgccttggtgcgccaagcatgatgggctcttactttttcccgcaaatcattatggcgtttaaaagccactttccgaatctgaaaatgacggtgattgaagcgggtactcaatcgatccgcagaatgctgctctcaggcgagttggatattggggtgattttgaatcacgatctgccggacgatttggctgcagatccgctgctctcttcgcaaatggttgctgtagtcggcaaaaatcatgaactagctgaacgtcgtcatcttacttttgccgagttttttgagcatgaactggtaatgtttaaacccggctattttcaccgagattttatcgataaagtgtgccgagcacataaatttacggcagatttttcttttgaaaccaatttgttacctatgattttaagcatagtgaaacatgaatatgcgattaccgcgctgttggagttggtgaccagcaatgaaccggaagtgaaggcgattccgtttgaaccgccggtgtggcttgatcttgcattggcttggcgtaaagaaggttatctttccaatgccgatcgtactttcatcgagtttgtgaaaaagtacgtttagcgccaagaagagcattcatctttgctgctattaatctttactgctgtaaatacgttcaaaattggtgtggttccagccgatcatcaaacgatcaccaatttttagtaccggtacactgcgagcgccgagagcatcaagctctttgcggccgcgttccatttttgcgttgcataagcggtacttaatgccttttgagtcaagataacgctgggcgtctttgcaatgtgggcatttatcttttatgtacaaaaccacgcgtttcattggaatctctcatgaatcaaaagggcgcaaagtgtaacgagagtcggctggagatgcaaatatccccttcctacttgaagcgatcatacttattggtgtaggtgattcttgagtggaaattgagtaaacttgccgaccttttttgtcacccgaactgagcacgcgaaatgagtatgcaccctgcactgaagtacattcagggatatccccaacacattgttgaacaagttgctcaactgatcgcaaacgacaagctgataccttggtttgagcagcgttatcctgagcggcacgatatccagagtgaaaaagcgctgtttgacttcaccatggctttaaaaaaccaatatatgaagaaaacggctccgctcagtaaagtggtgtatgacggaaaaattcatctcattaataatgcgctggggttacacagctacgtttctcgggtgcatggcaataaactgaaagcaaaaaatgaaatccgtattgccaatgtgtttaaacaagctcctgaaccgctactgcgcatgttggtagtgcatgaactggcgcatttaaaagagaaagaacacaacaaagcgttttatcagctctgttgccatatggaaccgaattatcaccagcttgaactggatgcacggctatacatgatggtgctagagcttaaggcaggcaaagcatgaacactccacttaagccaaaacatgggcaaaaaacaaatcgaaaaccgaaagccaataagccagttgtgaaaaagcagcaaactaagcagccgccaacccacaaagtacaaggtgaggaagtcgctgccgttaaatctggattacatccacgtaatcgtcaccgcgggcagtatgattttccggcactgattaaggtcgtgccagagttgcaatcccatgtgatgaaaaatcctaaagggcaatggacgattaattttgccgatccgatctcggtcaagttactcaataaagcgcttttggttctgcattacggtgtcacctattgggatatcccagagggctttttatgcccgcccattccgggtcgtgcggattacattcatcgcgtggccgatctattgcttaaaggcaatccccaattaaaccactctcaagtcagagcactggatattggcgtgggcgcaaattgtatctatccgattgttggagtgacggaatatggctggtcatgggttggcagtgatgttgatcctgtttcaattcaacaagcgagtttgattgttcaaagcaactcgaagctgcaaggccatatcgaatgccgcctgcaaaagaacagccaacatatttttaacggcattattggggcgaatgagcgttatacggtgacgacttgcaacccgccttttcatgcatccttagcggacgctcagcaaggaacccagcgtaagttgaccaacttacaagcaaatcagcgcaagaaaggccgcttagcaacgccaacgttaagccactcaaggttaaattttggtggtcagaaagccgagttatggtgtccaggaggagaagcggctttcattggtaaaatggcggtagaaagccagcagttcgcgcagcaagtgctttggtttagaactttgatttctaaaggtgataacgttcgtggcatgaaaaaacagctggaaaaactcggggctcagtcgatacatgtaatagagatggcacaagggcagaagataagtcgctttattgcttggagttttcaaaatgctgagcagcgcaagctgtggtggcaggcaaaatgttaagctttaaacaagttatacccttcctagttaaagttgcagcggtgttggctacgttcgttcaccccaatcacatagttcgcctatgctcatggggattcacttacttgccgcctacctgcaactccaagtcgtttgggtatactgaacatgaaaagtaaaaagccaatcgctcctaaataaaaatccaggaggggcaagatgagaattgaagacgttccactctacgcaccctgccagcctcattggctgtgcgttccttttatgggtatttttgcgttattactcttgattggattggttttttttattcgcattatttatcgcgaatacttaaaaattcagcgcgcacaaaaagtgcgccgattgcggcgcactcattatcgagatcgtcagggcggtggtcgtccgaccaatatcaaataaaccttaagagagagaatttaatagggtttgatatttttgctctaacgctgaattcccagcgcgtttttctaattcaatcagtagtttgagtgaggctttttgatagccataacgctgattcaagtccattaaacgtaagcgagcgggtgtgtagtcgccggcttcgatctccattttagtcagctgtaaaatggacagaagacgatttggatcgtgatcgatagcacgtttgaaatattcacgagcgttgtccgttttccctgctttgagagcacacaatccggcgttctcgtaactggctgaaattaagtagtaataaggttgctcgaccgcacggcgaaagtattgatcggccgtgtcatactcgccttgcttacacaaaaaggtaccgaagttattcagcacattaccgtttttcgggtgctcgcttagtgccgtgcggtacattttccgcgcagaatcattctcaccaacagcctcataatagtgcgccattgaaagttgtgagcggtaataatccggcgcatgctgtagtgctttttctaaattttcccgtgctttgatcatgctgccattttctaaatagcctaaaccaagggcaatgcgcgcctctgccatctcagttgggtcactttgcgttgcgttacccgccgtttcagtgacggtgacgcagcctgctaaggcgatgatgagccctaaaccaaacacatttttcatacatccctcccgttaacgcctcaatgataggcaattcaattgggaggccgagcggtgagagttaagtctgcgagtcagttggcaaatctatttatgtatcccccttcagactttaagctgcaacgccaagtggatgggatgtcaggcagaagctaaaggcggaaaggcgagtaaagggataaaaggccgcacagggcggcccgaaggattattcgtctttggtaaaattggcttcgctgaatttttccaaatcatacggtgtttgttgataaacgcagtagttaagccagttggcaaacagcaagtgcccgtggctacgccaactggcgcaaggtttgttatctgggttgtcattggggtagtaattgacggggatcgcaggattaagcccttcgcccagatcacgcacatattcaccatgtagggtgtaagcatcgtactcagggtggccagtcacaaacacattacgcttatctttggtcgctgcgagataaacgcccgccacatcggacgttgccagaatatcgagatcagtatgctcagccaaaaattccgcatcaaaatctgcgtagcgagagtgcggagcgagaaagcgatcatcaaacccacgcagcaaagggtgaaacggcttgtggatgtcgtggtaatagacaccggacaatttctcttcacgcgtacgtttgggcaaattgtacagcagcttcagcccagcttgcgccgcccaacagatgtaaagggtggaggtgacatgcgctttcgcccaagccatgatgttttgtagatgctgccaataggcgacatcctcaaattgtactaagcccagtggcgcgcccgtgatgattaacccatcgaagttgcgatttttgaccagctcaaattggcgatagaaggtgttgagatgctcttctggagtatttttgcttggcctgtcatcgatgcgcagcagctcgatatcgacctgcaaaggggagttggacaagaggcgtaaaaactgagtttccgtctcaatttttttaggcattaagtttaacaatagcaccttgagtgggcgtatttcctgcgtcgaagcacgcgattcggacataacgaagatgttttcgttacgtagcacatcactcgccggtaattggtcggggattctaatcggcacagctttctccctaagcattaatttggacgtctaaacatccagacttataactcaaccgaaaattattgtcgatagcaaaatgcaacgaacctcaatctaagttagtatctctcggcacaattgactactgtgaatcaagtatgcgacctcatttaacccttattcgcggtttgccaggttcggggaaatcaaccttggcgaagaccttgtctgctgtacatctggaagcagacatgtattttgttaatccacaaggtgagtaccattttcgccccgaatacttggcgcaagcccatgaatggtgccaacaacagacggaatactggctgcaacaaggcaaagacgtggtggtatcgaatacttttgttcggcattgggagatggcggtataccgaaaacttgcccgacaatatcgagctaagctaacgattctggtgtgccgagaacgttatcaaaacgtgcatggggtggatgaagccactgtcgaacgcatgcgtcaacagtggcaagagtagacattattgtgggggtttagcggtacgctggcgaactcggcgtaaaagataaaacgccaaaccgccccataccaaagcctgtgcccaaaggagtgtccattttggtgctatggttgaccaactggccgccatttggtttaaacccagaaagccttggattgccggcgtgcttgggaagcactgcgcaagccagactaaaggcgcagggatcatttccaacggccaaataaatccagcggtaaaaatcagtggcatggagctaattaacaccaccaaagtgaccagttcgcgtcttggagtcactgcacctaacgcaataccgacaaaattacaggctaataaaaacggcaggagcaaactaataagatcatttggctttgctaaagtattcacgccgtgcaaatcaaaactggcaccgaaataataaagactgagcaagtagtagaccgcaaccagcacaaaactacgcactaataacagtttggcaggagcgactcggctccaatagccgtggccttgcttttgtgtcccaaccatcaatccagctgccatgatcagcgtttgctgcaggatcaatacaaaaacggcaggtacgacgtaatcgacataacccatgcgtgggttaaaagtgggtttcaggttggcactggttggcgagaaatgctgcgcggcaaacgccatcggttcaccttcgatgaccaaacgactgactttggtttgtgctgcgagtgtaccgcccgcttgggctaaaccttcaacaatcgtaccgtaaaccagaaaataggaagcatcacccgcataagcgagcgttgggcttttccctaacaataagtctttgtagaaatgctcagggataaccagtatgccagccactttcttgtctaagaaagcttgtttggcatcggcaatggtgtgatcacgctgaacaattttgacttgcggtgtggcatccaccatccgctccagttgaaaactggcctgactttgatcgagattgaccacagaaacggtctgttcacgggggatctgcttggcgtaaggcagcgggtagaggaaagaataaaacaccacgccaccaaaaacggtcagcacgacaacagggttggtgaagagtgcttttaattctgctttaaatagctcaaatagggtcatacggctgctcccatttcccgcgctaaatgcttgcggatcagaagtagcgccaaaccaagcggcagaagatagccccacatattgaccataggttgtaaagaacttaaggcctcaagcccatagctcacttggttcacttgcacttcaatgtagtggctgatcggtaacaaattgcgccatgcttgagcgagcgtgttcatatcgctcgccggaaaggtaatccccataaaggcaaaactgggcgcagtgaaagcgccagcaaagctcatcgcgcgagcgggatcgagcgtgaggaaatagaaaaatgcccccatgatcacgcatgccaccacggtaatcgattgagcaagcagcaaagtggaaaagtgaccaaacataggccagcgcagtacatcataaaaccagatcaaaaaaccaagtccttgcagcatgaaaatggggagatagggcaatagggttcgagttaactgggttaagggagactgtgcgagccaagactttaacccgtaatgacgatagttggctgccagaatcaaaatggtgctaacgacaatggtgatttgccacaatgcggggacaatcgccgacaccaaaaattgcgcgtagttggtattttggttaaagagtggcgttatttgtgtgcgcacgggcaccgagcgccccatggccgcaagggtagtatgcgttttggtggcgagatttttcatcacatccacttgagcattaaatgtgccttgtgcttgcaccaccgctgagttaacgagcttaccgaccaagatcatttggctgttgtagaaggtcgttacttgcggctgctcttgacgataaatggctttatcgaattgtgcggggatcaccataaagccatagatctgattactgcgcattgcttggctggcttcatcgacgctcgcaaaatgctgactgacaagcagtgtcgatgtcgcatcgacctcacgaataagctggcgtgaaagctggctgtgggagaaatccaccacaccaaacggcagatcgcgcgctatgccttgggaaaaaatccaccaaatggagacggcgagcagaatgggcacccatgttaaacaggaaaataaccatttatcgtgacgcagtaacgtccattgacgggggatggcgtgcttcattttaagttcaaccacaacttataacttaaccacaacgctcatgcccatacgcaggccttcggttggcgtgactggacgtgcttccacttcaaacgtacgcaggtcaaacccttgagtggcatcggttgagcgccaagtggcgaaatcgcccatcacggcgacgtgagtgactttaaactcgatggatttattcagagctggcaaataagccgtaaactgagcaccttgggtaaagtgtttgagcagatcttcacgcacgttaaatactgcccaagtgtcttgcgtatcgaccacagtgacgacagggaaaccttgcggagccagctcaccactgtgcatcaagacttgtgatacttcaccatcaaaccaactttgaatcttggtatcggcggcatatgcctcgacttcagccaccgcaccagcagccatgcgtgctttttcgagcgcggcttgtttcgtctcttctcgtgcaccttctttggctaattggtacatctgcaacgctgcactttcggtgtatttggcggcttgccattgggtttgcgcttcgtcccgtttttgttcggaaaccacaccatcgttgtaaaggttattgacgcgcagatacgttttttcagccagttctgctgccgcttgggctttgagccattgatctttggcggcctgaatctgctgttcacgcgcaccattttctgcttcttgagccagtgcccccgcggctttctggccggcgatcgcttgttccaacttggcatcaatttcagggctgagtagagtgaagatcagttggcctttttccacttgatcgcccttgcgcaccaaaacttggtcaatgcgccccggcactttagaggagatgctgtactgctgagactcaatctggccttgcagtgtgactggctcaggttgataggcttgataaaagcgatagccaatccagccaacaacagcgacagcggtgagcgtcattaaggtcgtttttaccgttttcatttggattccttttacttagccgtggcgctttggtgcagtgaagagagagcaactgcggattgatggtaagtggagaagctgctcatctcgctcgacagagccaataatttgtttagtgaaattagatagttaaagctcgctagcgattgttgggtgcgaatgctggccagataaagctcggcatctaccacatcgacggaggtggataaaccttggctgaacgctttttggcgtaaacgcaggttctcttgtgccaagttcaggctggaattgagtcccgtcacttcttcaagggcttgttctgcctcgagataggtcttttccaccagcacactgagatcttgtttcgcttgcgcttttaaatagcgcacttgattcactgcgctattggctgctttgacttgttcactgcgcccgctgttttcaatcagcggaatattcacaccaacgccaaccaaccaatccggtttcatttggctagcgagtgagtcatcttcatgcaagctataatcgccatacagatagacttctgggtagtattttccttgctcagctttaatgagactgctggcttgcttttctttggcatcgagcaggcttaagccgggataggtattgagcgtttgttcgatgaaggcgtgcatgggcggtaagctggtgttgatgaacagcatgccactcggttctacggtttctgtagcgcctaaaatttgggttagcgcactttgcgcaatgtccaaggttttttgtgcttttttacgctcaactttggctttatccagtgacgcatccgcttgcaggcgctcgacatgagcaatttgtccttgttgctcaagtttaagggcattatctctgtgttgcgtgagtccctcttcaaccgcgattcgggtagcgagcacctctttggccaacactacgctaaagtaatatttggctaaatcttcatatcgcgcttgtatttccatcgcgagctgactttgcgcttcctcttctttacccgcggcggcatcttgcgcagcagtaattcgtccgccagtaaaaattggccaaatcgcacggatcgaggaagtgaaaatatcgcgttcagtgatggtagatttagcggctcccagatgagtaactagtggtaagagactaggcgataggctagcaatcagatttgggtctattccgccagcgctgtctactatctgcttgccggaaagtgttacatcctgatcaagccgcgtaaaattggctcccacactgaccgagggtagattgagattttgtgtggcatctttcagatgagcgtaacgttccacattggctctttgcgccgcaagcgagttgttttgttgttgcagcaagtcccaagcttcttgaaatgagagaggcgctgcatgagcaatcggcataaataatatagagcagatcgccagagagagagatttcactttcattttgagctcgacagaatgaatttagagctaatgctctattttttggatgatgaagtcaaacaaagagttaaggaccgcagtataaaaaactgacttgcaagagcaagccagttgtttgagtaatcggttttgacgcccaaaaacgtctcttgaacgtaggaaagtgatcaaaaatgagggtaggaggggcaatagtaatcggctctccaaactaactttttggttccctgcatagtcgtcagtacgtctttgcctgacatttgaggaaaagcgaacaaaacacgcatctcatcatgcgtttctggctcgatttcgtaagccctcacatgagtaaatgtcgagtgtaaatgctcacaaagcatgtctttggataggcaaattccaaaagcatctcttctcatgtctctattccttctgacgtgttattgagtgaacttggccgcaatttctattctcagtcttatgcctgaattgcatcccagttaggtttatgctcactgcgcattaagtatactgcttaacctagaaagttgccggagcaaagtgcctatttgttgtgacctgtgccataaaacagatatgcaattggttttatttttttgatgccatgatctgccttgctggcatatggctaacgtgaatctcgtgccagcctcacagttatgtattgcgagcttcgccccaatgttaaattgatgttagctttcactcgctagcaaggagtgaacaatggtgtggagcagtatcaccttccgcaagagaatgctgatcatcatgaccttatcgggtctgattgagctgctacttttggttgccgcagggtttatgtacgtcaaacattctcaagagcaagaggttggccagaaagcgctgggcgttgcggcattccttgcacaaactccagcggtcatcaacatgatcaagaccggccgtgcttccgatgatcagcagcaaagctatcgtgaactgactcaactaataggcgcagcgtttattgtgattggcgacaatcaaggtattcgattagttcatcccattgatgaaaggatcggtaagcctatggtggggggcgataacgagagagcgctagtggaaggcgaagcttatgtctctttcgctcaaggttcgttaggcaaatcggttcgtggtaaagcggcggtggtggatcaacacggtcaaatcatcggtgtcgtttcggttggctatttaattgagcggctacaagaccgcgttgagccatttttattctatctgattgctaccgcgttactggtggtaggcgccaatgcactggtttctagctatgcctcacgacgttttcagcgcgctattttggggtttgagccggaagaaattgcccgtttgtacgtggaactggatgtgaccatgagcaccctcaaagaagggatcatcagtattgatgacaaagggatcttacgttcgatcaataaaagtgcttgtgaaattttgggattacgccgcgaacaagctcttaatcgacgcttgaccaccattctgccagaaagtgatctctatacggttttggcgaccggaagaaccgatcacgatattgagctctatctgaataagcattggataattgccaaccgcagcccgatcgtggttgagggaaaagtcgtcggggcggtatccagtttccgtctccgtgatgaaattaatgaactcactgagcagttggcccaaacccgtgagtacgcagagatgctgcgttctcagacccatgagcacaggaataaattgaatactattagtgggttactgcaaatgggtgaattggatgccgtgcagcaactgattggtcaagaaactgagcactaccaagtgttgattgagtttttacgtgaaacaatcaaagaccctctgattgcagggatgctgcttggcaaaacagagcgcgctcgcgagctgggcttggaactcatggtggaagacggggcacgtttagaaacgctgccgattcatattaaagcggaagatgtggtgaccattctcggtaacctgatcgataacgcgtttgaagcgaccttaaccgcgatacgtacgctgtcgccagttccaccggaacgcagagtgattgaggtctcgatcagtgattttggtaacgaaatcattttggaagtggatgatcaaggttgcggtttacctaaagagctggaacattggcagctaacggaaaaaggggtgtcgagcaaagccgtgcaaaaccgaggggtggggctgtttttagtcaaacagcttgccgatcgttatcaaggacaactggacatgcacagcaaagcgcaaggtactcgaatgacagtgtatttacccaaggatgagttgtaatgaaaacccgactcctgatcattgaagatgatgctgcgatagcgcagcttcatcatcgctatttaagtcagttagaaggctttgaggtagtggggatcgcgatgtctcaagcggatgcgcgtttacagatggaagtgcttaaccctgatttggtgctgttggacgtttatttaccggatggaacgggccttgagctgttgcaatggattcgtggacgtaatgttcattgcgatgtgattttaattacggcggcgcgcgaggtggagacactgcaacaagcgatgcgtggtggtgtggtggattatctgctcaagcctgtgatgtttccaaggctggaaaccgcactaagaaaataccaaatgcggcaagctgagctaaaacagttggcggattttgatcagcagaaagtcgacaaaatgttcaccacacattcctcagaagccttaccgcaacgtttaccgaaaggcattgacgccgtgacattggataagattcggttgctatttcaaacggctaccatgctgacggcggacgaggcaggtgaaaaaattggggctagccgcacaacagcccgacgctatcttgagtatcttatcactgctggagagttggaggccgatctcagttatggtacggtgggacgcccagaacgaacgtaccgtaaattacatcgtcacacatcctgattagacggattggataactgcatctaaagtttaaacagattacacgaatgtgatgaggtcgacagatgcaatggcgtttttgtttgacaacagtactgggtgttgttctgagctttagtcctagtgtgaaggttcaggctcaggggctggaatcgttaacgtactacacagaaaactatccaccactgaattttgctaaagaagacggtaaacccgcggggattgcggtggatttactcctagaagccgcggcggcggttaatgtcaccttgaacttggatcagatttttgttcaaccttggccacgttcttatcggtcggcgttgttaaaacaggatggagtacttttttctacgacacgtacaacacatcgtgaaaatttatttaattgggtcggccctattgccgatatcaaagtggtagtgctggcacgaaagtcgagtcagatcaaagtgaatgaccctatcgagttaggaaattaccgaattggtgtgatccgtgatgacattggagaacagcaattactgcaactcggtgtaccacgggaatccatggtagaaggttccaccgtcagtagcttggccgagcaattgctaaaaaaacgcattgatctgctcgcttatgatgaaagaaccgcactttggtggatgagccaagatagctatcccgttgaagaatttgaaacggtatacgttttgatgcaaggttcactgtattacgcatttaacaaaaacatagataagtcggtattgaacgatttacaaaaaggcattgagctgatcaaaaacagcgtcaatgagaatggtgtaactcgttatcaggcaatactggacaaatattgataaccatcccgagaagatgtgacgattatgagcaacccaagcagtactattttgactgaaagcggcactaacgagctagaaatcattgagtttcatctcgaaaaagtgcttcccgatgggcggaccaaaacctgttattacggcattaacgttgccaaggttcgtgaagttattcgggttccagagacgactgactatccgaatgcccagccacacatgattggggtattttcttcacgggaaattttaacccccttggtggatttagccggatggctcggtgtgccgacttcaacggatatcagtaagaaatacgtgatagtcaccgacttcaaccgtatgacgaatggtttcttgatcgacagtatcagccgtattcatcgtatttcgtggaacgatgtggaatcacctagccagttcctcgaagcaggtgagcaagattgtgtggttgcggtcgttcgacaagacaaaaagctcatcatgatcctggattttgagaagatcatttctgatatcaaccctgaactgagtatggaaaaatacgatgtgacggtggatagaaaagtcgacctcaaccagcgtatggtgaccaagcgtaatgcgaaaaccattatggtcgttgatgactctgcctttatccgaagcttaatccaagacacattgagttcagcgggttacaacattattgcttgtaaagatggtggcgaggcccatgaaaagctgatggagctcaagcaagccgcaaaagaggagaatgtgccggttagtgagctgatcgatgccgtcgtcacggacgtggaaatgccaagaatggatggtatgcaccttattaaacgtttacgtgatgatgattcgtactcctcgatgcctatagtcatgttctcatcattgatgagtgatgataaccgtgccaaagcattagcacttggtgctaatgatacgttgacgaaacctgagatcggtaaaatggtcgcgatgatggataaatatatcctgaatatgtgagatgggtggagcgttgctccgcttttctcaggagcgagaatgtcgccatcactcatgtgttctacagtaaagaataatctgtatcttgctggcagatgaaaggtagaagatgaagtcgcagtggaggcgatatgcgcatatcttggttatccattctcctatggttctcgacaagtgcttttgctaaccatcaaaccattactttggttttagcggcacaaaacgataacgggcatgcctattatcatgagttgttggctcgtgctttagccgatcaaggcatctctctagtggtggaaacgccatatactcatttgccgcagaaacgagtggtgaaaatggttgaaaacaatcaactgtcactcacttggttattggaaaccccagagcgcaataaaaagtttgttcatgtcgatgtgcccctaaccaatggtttgatagggcaacgcattttattaattccgcccagcttacaaagccgtttagataaagtctctaacctaaatgaatttcgtcaaacacggctggtggctgggctaggtgagggatggctggatattgccgtctggcgctccaaccatttacctttttatatccaaaatggagagtggcgtggcctatacaaaaagctttctgtctcgggggcggtgaactacttcccgcgcggtgtgactgaaatctatcaagaatccattctcaatccgcatttagcgatagagcagcatctattatttcaatatcagcgagattttaaattttacctcagccctcaagctgctcagtatcaagcactattggaacaagcattgaaggcggcacaagagtccggcttaatgcgtgaactaaccgagaagtattggggagaatcgctctccttattaaggcttgatcaaagacaggtgattgagttgcaggtacctgttgaagataaataacccgtgtttccctaaccactttattttccgcacaaaatcagcaatagaaactggtttttcagtacaacatcagttatcaatgacactaattcttttctttggctcaaatactttatggttgaaatttttattgtcgtcatactgttagttctgttctttttcgtgattcaaaaatatgtcattcgtcacgatgacacaaaggactatgcctataaaaagaaaggcccactactggatatgaaggaaagcgctttctttaacgcactagtgagtgcggttggcgatcatggcgtggtcttagcgaaagtgaatatgaccaatgtgatcactccaagtaaagtcgcgaacaaaaagcactggtttattgcttataacaagatctcaaaaagctactttgactttgtggtgtgcgatgcaagaacgcttgaacccagagtcgtgctcgaattggatgatgggaaagagctgcaaaagggcaaagtagaacgagaaaagttgctgctgcacgtttgtaaatcggccaatatcccattgattggcaccaatattcgcatgagttatcaagttggcaagttaagacgtttactcgccgcgcacatcgatttaattcaaaccgagcaggaagtgcgtttttgtaaacgctgcggcagtcctatggtgattaaagttgccacacaaggagaataccgtgggagacgattctttacctgtagtcgacaaccacactgttcctacacggagaattacaacgtggtttatgaatttgaagaagaggacaacgccagcaatcccagcgttaattaaactcacacgttctcggtttgttgattaaccatagtaggattggttgagccatgtctgaataggcgaacctgatttcttcccgcctttttggctcgatacaattccatatccgcaaatttcaggagatcgttcagttgatctcctgcttgatattcacacacaccgatactgatcgtcacttgtactcgtttctctctaaacgcgaacagatgctggctgacaatcgctcttaagtgttcgcaaacacgcccagcttgctcaagcgattgatcaaataaagtaacgcaaaactcttcaccgccaattcgatataaattgttgtcaccgacaacttgagtaaaaaggcgagtggtttcaatcagcactttatctccggtgtcatggccgaattgatcattaatcgatttgaaaaaatccaaatcaatgacgagcaaacagagtgaggtttgatcactaaaccgttcaaaatgttgaaatgatgtagtgagtgacaaacggttgtgtgcgccagttaaaggatcacgcgaagcaagatagagtagggagttttcaattttacgtcggttatcttcgtaaacatgggcaaccacccaaattccgatataagcaaagcaaagatgcaggagcactgaccaagagagggccgcgccagtttgctgcaactgccagtaaataatgttgctttgtatgatcaaaaacaggcaagaggtaacaaaggcaaagcgagcagaggtaaaaatgtaaaacaggatgggaacgaagcagctccaaatataaacccccatcattaaaggcttcatataggtcgcgaaaagcgttgtgccagttaatataaacaaataaagataaacttgttgtttggtatgaatacgacgcttagccagagaataaatatacagggagtagaaagcgcaaacgagctcaagtgacgcgagttcgactaaccgtgttgaccagaaattgatcagcgccatcaagaaagcgatcaaagcccaaaagaaacttaggccgcatagcactgaagctcgaagcgtttgtgtattgtcaaataacctagcatccatgcactcaccctctccggggctaaacgtaagcgtttatagtacagagttgaatatcttgatcaatattgatcttgaatgcatgtcacaaaagtagacggcgctctaattctgcaaactcttcgcggttcagtaaatccaggccgtaaaagaacactaaaagcacaaaaaaacatcaaaatgatgacagaaaagccaaacgattcaaaaacaaagaaattgggcttgcacgtcagaaaaactgccgctaatatccacctcgttctcaagcgatgcgtccgtagctcagttggttagagcaccaccttgacatggtgggggtcggtggttcgagtccactcggacgcaccatgagaagcttaaaaacagtatgcgtctatagctcagttggttagagcaccaccttgacatggtgggggtcggtggttcgagtccacttagacgcaccagaatttgttcaagatgaacaccccacaaagcccgcttaatgcgggctttgtgcttttcatcactacaactatttgcggctgctgtgctcttggcaacgccgattgttggtctatctatgctcatgggtatgagttcacatgcctcttacctgatattccaagtctatcgctactgttttttcttcttcttttgcgtttgaacgaggtaatgattaaacacgcctaataactcttggctgcgcgcactttgcttgggaaacagcagataattactgttagtgagaaaaggtgtggggtggtgggtgatcaaatcttgcaaatgtggaatttgttggttgatgaggtagtagccaatatgtttttcctctggtaccagatcgactcggcctttagcgagtttttcgagattttttgccgctaagccatcgcgttccatcgtcagtacgccagagtcgagtagggcatccaactctttaccatagctgtaggccagtacgccgcctaacttataaggggctaaatcgcttaaggttttccaatcaaatggctttttaacgggataaaagaaaacaaactcttcttggctcactggcaagctatagaaaaaatcgatttcacgctccgcgctgtgcatccagatcgcagtggcatcgtacaaaccgcgttgggtttcagcataagctcttgcccatggtaaaaactggaattccacttgataaccttgcttggtaaaagcttgggtgatgatttcaccaacaaaaccatagttaggtaaatcactgccgataaaaggtggccattcgccggatgcaatacgcacgagtttatcctctgcgttgggggaggattgtgcatacagcagcgcgggacataatcctatgatgagcaagcagcagcgcacataacgttttaagtatccgttgctcagcatgacggttccttggtggtctaggctagtctttgaatcatgggtaagttgactcctcactgtcaaatcataggtttaatttttatcggcttttttgattcagttgacgaaatttaaggagtaagcttgagcgcgagatgtccacatcatgctgattttatgaatatcttaagtggatgttgtcgtgttctagtgagttatcgatgaggaaggtatgtcgcagcctgtagatagaaaaacctttttgggcatcttttttacggtttttttgccaatgtttttggcggccgttgatcaaaccttgctggctaccgcgacgcctgcgattgtgcgcgatctcggcaacttgcaactttcttcgtggattgcgattggttacatgctggcaagtgcagccagtgttccggtttacggctggttaggggatcagtatggacgtaaaccgatgttaatgattgcgctgagtatttttgccttaggttccgtcatttgtgcttttgcaatgaatatgccgtggttggtggctggtcggattgtacaaggactgggtagcggcggcttaatgagcttatcacaagccttgatcggggaattagtaccgccccgcgagcgtgcccgttttcagggctatttttcctcactttttgcggtggccagtattggggggccagtgttaggtggtgtattggtaacctacctttcttggcaatggctgttttggtttaacctgccgcttgtgggcatcgctttgtatcgactggcacgatttcaatttgtgcaaagttcgcgtaagtctgaggcttcaattgatgtggctgggcttatcctgtttcccagtatgatgactctcatcatctattggctttcggctggcgggcactattttccgtggttctcggtcaccagcataagcctagtgagtgcatttgttttaacgagcttgctgtttatcgcccagcaaaagcgagtcacggcttcctttttaccactccgtttattggcgcgtcgtgaaatacatattccgttgctctccacgttcattttcgcggcttgtttgtttgcgctgatcttctttttaccgatttttttacagctcggcttacgagttaacgcagcacaatcgggactactgcttatccccctgtcatgcggcattattggtggcgcctatacgaccggtaaagtgattgctaaaacaggagtgcccaaatttttgcctgtgtttggtatgagtttaagtagctgcgcctttgctgtgttggcgatgttttcactctctgcgcccgtggtgagtgcgattgctgccttatgtggtttaggcttaggcactgtgatgccctcaacccaagttttagttcaaacattggcaggcaaagccaatttagggcggatcaccgcgatggcttcactgagccgctcgttaggggcatcggtcggcaccgctttctttggtacattgatttactccttacttcccggtttatcgccaaacagtggtttgcaggcgattgccgcattgccacaaagtgaaattttgcatgcttttcaaattggctttgcggttgcggcgctgcttgcgttgctaggggcattgaatgcgttgcgcgctccgaaaattcagttggatgattacgcctttgactcttaaatatcactatacctaaacgatttggagttgcaggtgcagtaaccagattgactcgccctgtacgccttgtgtaaacgtttaactttgatgcttgaagagagcatgacatttctccctcaattgggcggagtgccacgcgcaatacgctgtcactgaccgtcaaccattcccgttgattgggtgttccttgtctgctattgctttgacatccattacctttttatcagacttcacaatatgcggcgtttagagcagatgagtttggctgccttagtgataacttgtgaaagcgtttacactgtgcgattcacttcacagaatgttcgatagtaggattgctatgcttggtaaaaggctggactgtgcgtcgtgagcctactgtttgatctttgctaactgccttctcactcgattgttgcagtggagggcgtgagagagtgttcatgtctgagcttaagtttaatcctgtcgatcatccacaccgtcgatataacccattgactgggcagtggatcctcgtttcacctcaccgagcaaagcgtccatggagtggggccgatgagaaaccggcgctcgctgagttgcccagctatgatgcgcaatgctttttgtgtccaaccaatgctcgtatttctggggatgtcaatcccaactataccggcacttatgtgttcaataacgattttgctgcgctgatgacggattctccagcagcgccagaatccgataatccgctgttcaaaactcaaggcgttcgcggtttgagtcgggtgatctgtttttcacctgatcacaacaaaacgctgccagagttacccgtgcataagattcgtggcgtgatagagacatggaacgaacaaatcgaagagctcggtagagagtatatttgggtgcaagcttttgagaacaaaggtgaaactatgggctgctctcagccgcatccccatgggcagatctgggcgaacagttttttacccaacgaaatagaacgcaaagagcagcacctcaaggcttattaccaacaatatggccgcaatttgctagtcgattacgtacaagcggagctaaaagatggcgcgagaaccgtggtggaaaccgaacattggttagcggtggtgccttattgggcggcttggccgtttgaaaccctgctgttgcccaaaactcatattcgccgcatgagtgagctcaatgatgagcagcgtgatgatcttgcacttgccatcaaaaaactgactagccgctacgacaatttattccaatgtgcttttccgtattcgatgggctggcactttgcgccattttttgaagcgggtaccgacattaaccactggcagttgcacgcgctgttttatccgccgctgctacgtagcgcaaccattcgcaagtttatggttggctatgaaatgctggcagaaagccaacgtgatttaaccgcagagcaggccgcagagcgtttacgcgcggtgagtgatattcactacaaagaacagcataaccatcaataacagatattttgagcggcgcagcaccaacgccagcgtcgctctccccatttaaagtgagaagccctatgtctgaattaatccaaaacgtgactacaacctttgcacaactctttggctatgatgctacgcaccttgtgcaagctccggggcgggtcaatttgatcggcgagcacaccgactacaacgatggctttgtgctgccttgcgcgattaactaccaaaccgtcgtggctgcagccaaacgggaagactttctagtgcgtttggtcgccgtcgattacgacaatgacacggacgaatttgacctgcgagaagagattgcctttcagcctaaaaaaatgtggtcgaactatattcgcggtgtaatcaagtgcttgattgaacgtggttttgagtttaatggggcagatattgtggtctcaggtaacgtacctcaaggggcgggtctcagttcctcggcggctttagaagtcgtgattgggcaaacttttaaagagctttaccagctaaaaatcagtcaggcggagatcgccctcaatggccagcaagcggagaaccagtttgtcggttgtaactgcggcattatggatcagatgatctcggcgcaggggcaagcgaaccatgccatgttgcttgattgtcgtagcttgcaaaccgaggccgttgcgatgccagagcagatggcagtggtgatcctcaattccaataaaaaacgcggcttggtggagagtgaatacaatacccgtcgtcagcaatgcgaagccgcagccaaaacttttggtgtgaaagcgctacgcgatgtcactttggcgcaattgactgcaaagcaggccgaacttgatcctgtggtggccaaacgtgcgcgccatgtcatcacggaaaatgaacgcactttacatgccgctcaggccctgcgtgaaggaaacatgccgcgcttaggcgagttaatggccgcttctcacgcttcgatgcgtgatgattttgaaatcactgtcaaggagatagatacgctggtcgagattgttcaatctgtgattggcgatcaaggcggtgtgcggatgactggcggcggctttggtggttgtgtggtggcccttgtacacccgaagcaagtagaagcggtgcagcaagcggtggctgaacactatgaagctgcgacagggctgaaggcatcgatctatgtctgccatgcaacttcgggcgcgggattggttgagcttgcataaggttagagatgaacgcgttattcaccagcatgacagcacaggtcgcctatgatggtcagcctgccaagcttattgagctcactaaccgccgcggtatgcgtgtggtagtgatggacatcggtgccacttggctcagttgcactctaccgatgggcgatgaatcaagagaagtgctacttggcgtaagcagcatggatgattttgtgcgccaaggcagttatttaggcgcaacggtggggcgttatgccaatcggattgcgcgtggcgaactcaagatagggacacaaacgtatgctttgtcggtcaatcaagctggcaatacgttacacggtggcgttgtagggtttgatcgtcgtcgctggcaaatcacgcagcaaagcgcacagcatgtgacctttcaactgctttctgctgacggagaacaaggctttccgggcaacctccacgttgcagtgacctaccggttggatgagcaaggtggggtgaatatcgactaccaagccaccaccgatcgtgcgaccgccgtgaatctaacgaaccacgcctactttaatttgaatggcgctgagcaaggtagtgattgcctcaatcatcagctctggattgatgcaaagcagttcttaccaacggatgcctcgggtatcccgctcggggagttgcaatcggtactgggtagcggttttgatttcactcaaccgaaaagggttggggaggatttgcttcaagataaacagcaaatccgtgcgaaaggctatgaccacagttatttctttgcgccagagcgagatatgcacacgcctatcgctaaggtgtggtctgccgatgagaaagtgcaactgctcgtcagtacggataaacctgctatgcagctttataccggtaattggttggcgggaacacccaatcgccttggttcgcactacaaggattacgctggcctcgctttagaaacgcagtttttacccgattcccctcatcatccagaatggctgcaaccgagctgcatcctgcaacccggagaagtctatcgctatcaaacgcgctatcagtttgttttttaacatcttgggcataagactcagcactgaatcggtaaatctgctgctgagtcattctctttctcgctgtcggcaaccacttgattacgtcctgcttcttttgcttgatagagtgcagtatctgcccgcgaaatagcagcgggtaaactaccatcgataaaagtaaaaccaatcgaaatcgttgttccgtacaagctatgatcgtctttaactcgctgacgcaatcggtcgagcatgtaccaagcttctttgtttgaatgggcttggaacaatagtaaaaactcttctccaccaaagcggataatggtgtctccatctcggacatttttgcgcagacaagaggccaccgcctgtagaatgcgatctccggtaatgtgcccatattggtcattaattttcttaaagtgatcgatgtcgatcatcgcggcaatggagtgagggtgttcaataaacttagtactgattttattcagaaaatgtcggttattgagccgagttaagttgtcgatataaacatgacgctgcgccgctactttttgtagattgagtcgagtgaggaaccaagtcaaagtcagtaacagggttaaactggccgacattacccagtaaataagattaaacaagcgtactttgtcgttaaacacactgatcaattgatattcaccaaggttccaacgaagaaagctcaactccatgttttcaaactgcaaagtcccgtaatcatctcggtggcgcaaaatcgtgtaattcagtagagcgttatagtgtgcaatcggattatctaagaactgaatgtgattaccgcgaaccaagaccaagctgatgtttttctgtggtgctggccaaaatgaagcatggttgaaccatagcactcggatctgtttgccttgcacttgaaaaaataggatagaaccttctgcaaacgtgatgtttactgaggtagaagcgacaaaatcacttgctgaagtggtggattgaaccgcatcgataatgctcaacgggcattgttgtggggaattctcatccagcacacataaattgccatggtacagattgaagaattcttgcaactgtggagtcaatgagtgggtttctagatgttctagaattaggcttgcgtagtcaatacgggttttctgtagttcgacagtcagttgcaattgctctttttcataagcgtggatcttatcttcaaacaataatttaggcgtgttaatcaatactatgctgaccgctatcatcccgataatgatcagttctcctcgtatagagcgaagcgcaattctccagcggttatctgtgtccatcattctttttattcatcacatccggtgtatatacgctaatcccaatccttggtttcccagcaagtaagcaggagataacttgaggctataacgcagacatacgtggagtatcttgaaacattaggtactgaagaggcgtttctgtacgagctgactcgatgtttaagaccgtggcagaggaaaaactctgcgaatgatatattcgctgaggcgtaagttgagggcgaccgaataaatacccttggactaactcgatacctaaatccgctatggccaaaagttcggagcgcgtttctactccctctgcaattaattggcaatcaagttgttctgccagttgtaccaaactacgcacaaatttcagtttgattgggttactgtcaatgttatggataaagtagcgatcaattttcacaaaatccggctgtaattcagaccacagttttaatcctgaatacccagagcccatatcatcaatcgctattgaaaatccttgtgcttgtagatgttgaaccgagtttttcaactcatccaactgcaatgcaggggtgcgctcagaaatttcaaacacgacctgattggcggatagacggtgacgctgcatcaattgtggtaattcccactggtgttgttgtgaatgcagcaacatatctgggctcaggttgataaaaagctgtgaatcgatcccgaagcttgaccaagctgccgccgccttgtgtacacaaattttctctaactcgggtaagcgctggcactgttcagccgcttcaaacagagaacccgccgtatgaagaggactttgttgagggcctcgactgagcgactcgtaccctatagcacgctcgctcgcaaggtgcacaatgggttggaataacggggtaatgcgctgtttgcgtaaaatatcactcaattcattttggtaggggtggatgtgattcatggttgtccactaatacttatgcattaaacggctcaaacactagtcggttgttgtgacatttttattaattaatggccgattttttgcggtaaaggatccagtgtgtgcttttgttgttttaagtcaaagtccgtgatgctgacgatatgaacactcagtaacggagatctcgtggcgataaaaagagcgcctttcggcgctctcagctctggctagggttattcatcacgagtgaggctaaacgattttaggttgcccgtcggaggcggtggcaccaccatcaacgggaagattcaccccatggacaaacgaggcatcatcactggctaaaaaggcgacgacggcggctatttcttttggttctgcggctcggcctaaagcgatgcgttcattgaattgatcgcggatcgcttgtggccagccgttggtcatattggttttcaccaaacttggacataccgcgttaatgcgtacaccttgcgcaccgtgatccagtgctagagcgcgagtgaaattgactaccgcacctttagtcgcgcagtagaaggctgcgccccagtcaccgcctaagccggacacggacgccgtattcaccatgcagccgcgcgtttttattagctcaggtaatgcatgcattgcgcagtagaccactccatctatattaaccgaggcgatgcgtcgccaatcttgcacgctgcactccaacactgtgcccggaatatgaatccctgcgttgttgacgagaatatctagacgcccgaaacgctcgaccgttttacgtactaaagcttgcacctgttcgggatccgagacatcgactttttgcgcgtaaactcgcgcagaatcaaactgctcaatcacaatggctaactgctcttcattccaatcagccagcgctaaggttgcgccttcttgatataaacgttcggcaatcgccagtccaataccgttagcggcacctgtcactaaggcgactttatgggttaaacctctcatgcgaaaactccttctagggtttgaaatacgggatcttgattggcttcggtgcgcgcttgcatcaatttggggttatccgagtaatcgactggaatcgcgacgacggcggggccctcgacttccatcgcttggcgcagagtagggagcaactgatcgggttgcgtgatggcgtagcctcgagcgccaaaggattcggcgtaggctttaaaatcaatagggccgaattttaccccagcagcgcgatggtatttctgcacttcctgcatctcgaccatgttgtaagcgttatcgacccaaatgatgtgtacgatattgcatttgaggcgcaccgcggtttcgagctccatgctggattgcataaagccgccatcaccggatactgaaacgactttatggccgggtttgagtaagctggccgcaatcgcccaaggtagggcaacgcccatggtctgctgtccgttagataccagcatctgccgtgcacgaaaacagctcagatagcgcgcaatccatatgtggaaactccccatatcgagacagagggtggtatcgggtttgatgatcgcttgcatggtcttaatcaaggttagcggatgaaatcccgcattttgatagcgcaaaggataggctttgatggcgtgacgctgctgagtcacttcttccaaaatcgctaatgcagtcggggagaggcgagtaaaaccgggtagtgggcggcagagtgccgccaaattactggcaatgttaccgacaatttgtaggcatggctggtagtggatttgatactgcgcaggctcaatatcgatatgaacgatagggcagcgctggctattccatagctcaggatcgtactcgatcggattaaaaccgatggtgatgatcaaatcggcctctttaagcagcacatctccgggctgattattgaataagccgactcgtccggcgaaatggtgatagtagttgatgtctactgcgccggcggcttggtaggtgcccacgacaggtaactgggttttatgtaaaaaagcgctgaccgcttcagcagtggcttggtggctggcatgcagtccgagtaatacgacgcagcgctgcgctttttgaatccgttctacggcttcctgcaaactgtctgggtcggcttcagccgtgggctggtaagcactggggataataatttcgcttgaggttttatcggccagcacatcttgcggtacgctgataaaacacgcgccttggcgacccgattcggcgagacgaaatgcattagccatgatttcgctggtggcatcgacatgttgaatttcggcgctgtatttggtgatagaacgaaaaatactcaccgtatccatgctctggtgggtctgcttttgttgatagtcacgtttgactgcgccgccaatagcgatcatcggatcgccttcagaattggctgtcgcgacgcctgttacaaggttgccgcagccggggcccgatgtggctaaggtaactcccgctcgacctgaaagacgccccataatacccgccataaaagcgccattcgcttcatgacggactgggatcatttggattttggtatcctcaatcgcgtcgaaaagacggtcgattttggcccccggaatgccgaagacataacgcacaccaatagcttcaagctgttgggcgataagttgtgctccgctgcgcaagtgaatgttggattgcataagtgatccttagttacctgacgttacaccctaagtgaaagttgttttgcgataggtggatgggcacttcctgcacggagataatcgcaaccggagagcgctttcgccgccaatcacaagcatttcacggttgggcgattatttttccgctgcttcgatggcagtacggatgttattaggggtgaggttcgcctcaagaaagtcacgagacaccggagtgtcgaccaccaaacgcgaaactcgcccaatttgtaagaatccagaacggatgatgtaatcttgaatgtgtccgccacccgtccgttgctgagtaataaaatgttcgtggtagccgggcacgttgatacctgtggtgtattgcgggctgcgaaatccggcaatcacgccatgttgctgttgaaaacgaaaaacgggctgctgtttaaccacctctaacataggtcgatagggccgctgctgtttaggtacagttcgggtctgcacactcggaaaggtgccatcaatgcgaatcgcacaaaataggttgtcgcttgggactaatcggtcaatcaactgatgcacttgttcacgagtcatgcgctcggtaatgggcagctcaatatccgctttaaaaaagtaaaaacggcgaaaggcgtttgctgctcagggtgtgcgggttgggcagaaccatcagcgcgcagttgaaagacttgccgatcaaatgcgatcaattcgccatccagttcattaaacgtaccgagaccaaagtccccatgttctaaaagttgcgctatggtggttgcaccttcataaaccccagcgattaaggcgctcatcaatgaggtttgataaatctcgccttcaccactgatgtgttgatagtgggcaaattgctgagcaatctcttgtgagcatgaacagtgggcagagagtaaagggttcataagtcaactctaatatgaatctgtgtgtatatttaggttgacttcttagtggcgcaaaatccaatataaataagatttattttgatatagaaaatatatgggtggttgatggaatttcgttacatgaagtactttgcggccgtcgcagaggcaaaacatttcacgcgtgcggcggagcaacttggcatagcccagccacctttaagtcagcaaatcaaaaagttagaagaagagcttggcgtcaatcttttcaaacgattatcacgaggcgttgagttgacgcccgccggtgagcttttttatcaggatgcgaccagcattctccaacaagttgaacgagccaaagatcgagttagacaaagggcaaggggagagcatcttgaactgcgtttaggctttgctgcctcaaccgccagcagttctgtggtattagaaaaagtgcgccaactgcatgaaacgattccagatctacaattgatcgccgtagaacatccgatgccagagttggctcgaatgatccaagaaaaacagttggatatcgcatttatgcgtttaccttgttatgccagtgaagcgctacggcgaaagatattatttgatgacccatttgtggcggtgatccccgctgtgcatacgttagcggaagtggaaaagattcagctcatccagcttaatcatgaaaatgtattgatgtttccacgagaggtcgggccggccctgtacgacaatattgaagccgcattcagcgcagccggagtcaatatcgcgcgatcgtatgctgcgccacagttaagaacggcaattactatggcgcaagctgggtttggcattgcgatagttcctttatcgctcacagatcatcttgaccattcggtggtggtgaagacaattcaagatatgccgtttgtcagtcaggttgctatcgtttccgatgccggacatcaccaccctttactcaatcgctgtattgcgtgtatgggagagtgaatacagaagcaacattcgaccaagtgaatgtggtggacctgattcgctacctatcccaacgatccaaaaccacactatgaaggtggagtgaataaaaatagagcgtcaatcgacgctctatttttttatagataggcttacatcaacacttggacaatgaatattgacttaatgactacgctttatttttctcaataacgtgaatcgctaccgctaaaaagagaatatctttcaataaaaagaagtttggaaccaaaatcccatccgataccttccaagtatcaggcgttgtgatcagaaaacttaaagtgctaataaaaatcaccatgctcgcaatgccagagtaataagctactttagaagagcgtaatccaatcaataaaccaatccctactattatttctgtcgcaccaattaggttagaaaccgcttgtatggagagaaattggtaaatccagcccatcaaggggtggttaagtaccaaaggttcgattaatttggcttcggtgggggtaaatttgtaaatccccaaccaaatcaagatcagtgatacccccaacacaccgataagatagccgtattgagttgttaggttgtgcgttttcgagtcgtgcatgaaagctcctttaaacagatatacaaagaattattgagcaaaaatgagttcacatttgctggttcaaaggagatgacctgagaggttgaaaaattcattcacgcttttatatcgtatttggacatgagttataaccagtttaaaaaacagccggcatgcttaaaaaacgcccgagaatagagagctaatttaaccatctctaataaataattctgtgaaccaatatcacaaatattggcttaaaataatgacggttgataagtaaaaatatgagaagtcatctaaaactttcgtttaaatcgattttctctattaaattcatcgttatttcccatttagtgaaaagggttatttacccttatattctcgctgggcagaaaagagcttttgatttcttcattctccgcaacgtcggtcagaatggcaggtcgcattggagagcaaccatgcatatgtcaaaaagctttttaattatttcaatgggttttgtggcggtatccgtacaggcacaaactcttacgcgagacaacggtgcgccagttggcgataaccaaaactccatcacggcaggtgagcatggcagtgtattgctgcaagatgttcatctgatccaaaaattgcagcgttttgccagagaacgtattcctgagcgggtagtgcatgccagaggaactggcgcacatggtgagtttgtcgcatccggtgattttagtgatctgacactctcagcgccgtttaccagcaaaggcaaaatcacaccggtatttgtgcgtttttcaacggtgattcactcaaaaggttcgccagaaacgctgcgcgatccgcgaggttttgcgaccaaattttataccgaacaaggcaactgggatttggtagggaacaacctgcctgtgttcttcattcgtgattcgatcaagtttccggatatggttcactcgctgaaaccatcacccgtcaccaaccttcaggatccgaatcgcttttttgattttttcagtcatgagccagggtctacacatatgttgacttgggtgtataccaacttaggtacaccggcaagctatcgaaccatggatggttttggcgttcatgcttataaatggatcaatcaaaaaggcgatgtgaactacgtgaaattccattggaaaagcttgcaaggaattgaaagtttacgccctgatgaggtcgtcaaagttcaaggacaggactttaaccatttaacgaatgatctctacacacaaattaacgcgggtaatcaccccaaatgggatctttatgtacaggtgttgacaccagaacaactgagcaaactggattacaacggcttagatgccaccaaggtatggttggatgtgccggagaagaaagtcggtacgatgaccttgaacaaagtacctgacaacttctttttggaaaccgaacagtcggcatttgcgccatcaaacctaattcctggtattgagccatcggaagaccgtctgttgcaggggcgtttatttgcgtatgccgatacacagctttatcgcttaggtgccaatttgttccaactgccaattaaccgcccgttggttgaggtgaacagccataaccaagagggcgcgagtaacagtgcacaaactgcttcagacattaactaccaacccagtcgtaagcttgaattgaaagaggaccctcaatttaaagcggtacaaacgcagttggttggaagtgttcagcaaaaagcgatcagcaatccgcgtaacttttatcaagcaggtgtgctctatcgcagcttaaatgagcaggacaaacaagaccttatcaccaacttggcgggtgacttaaacaaagtcactgacaaagagatcaaagctactatggtcagccatttctaccgagcggataaggattacggtactcgcttagctcgtgcgaccaataccgatttgaaacaggtggcaaaactggccgcgatgtaaccgataaaaatttgccccgcaagagataaatccgctcttttctgcccagaaaatagggctcttgtggggcattcactatggcaaaggagaggaatgatgaaatggctatggcagctcgccctaatcggcttattagtactatccccttttagattgagtgtagcggcttcggagccgtctgatactgcacggtcagatacaagccaagagtaccagtctctgatctcactctttttcgcagcagcaaggacagggaatgacgaagttgtgaatgaatttctctccgctggatttccgattaatcaacgaaatgcggagagctatacagcattaatggttgcagcctaccaaggcaacgcacaaaccgtggaacttttactacgctttggagcgaatgcttgtttgcaagataaacgtggtaatactgctttaatgggagctctactgaagcgggaaatccaaatcgcgagagctttataccaagcagagtgtgcggataaccttcgcaataaagcgggactctcggtgcaagaatttgctgagttgtacggtcaatctgagacgttaaaagcgctgcatcaagaaaaattggctgtgtcgtcttccactcaatcacgacctctcaactaactgtgtcttactctcaaactctcaataaggatatccatcatgaatcaatttactttgtttgctgtcgtcgctttcttctcttcttcggttttggctcaagaaatgactgtggtgatgacggatttgagctctggccaatccgtgggcaccgtgaccgtaactgatagcgagtatggtacggtctttactccgcagttaactggcttgccagccggtttgcacggttttcatgtacacgcgaatggctcatgtgaaacctcgtccaaagatggcaaaaccgtattaggtggcgctgcgggtgggcattatgatccgcaaaacacgggaaaacacggctatccgtggaccaacgacaatcacttgggtgatctcccagctttgtacgtggatgcgcaaggccaagcaaatcaacccgttttggcatcccgcttcaaaatggcagaggtaaaaggtaaagctttgatggtccacgcgggcggggataaccattccgaccatccaatgcctttgggtggcggtggtgcgcgcatcgtatgtggtgtgattggtttataaaacgctttaaatattgttggccatcctagatggccaacaatattttatctcgcactggaatctgagctgggctgagtgatgcgttgccaagtgccttggagatatatctcaatcccttgatcagcaaaacgggccagatagagccattcatgcttaaccaaatgttcaaccacgcggtgtgaagccatcacttgctcaatccgttcgcgcggcgcatcaatcaccacagtgagacgtaaggcttcatgtcgccacccttggccatcatgcagcgattgcagggctaagccacagcgcagatcgcctccgttgccttcaaaaagaccgatatttcctcctaccacattatgcaaggttttattgccactgccgaagcggcgattatcgacggtggaggcaaaatactgcatgttaatccagtgtgtgaccagcattggggctgtcataatttgtgtcagtaattgcccttcgggatcgcgctccggttggtattcatgcaaaaacactcgaccatcgagtttcgcctgctttgaacgttggcgcggtgcaatgataaaagcggcattgttggtcagcccccattcagggcgagtttgcgcccaatcatgggctcgacgcagaaacgcttgctccaactgctgggcagatagggcgttgtccttgcttggaggcgcttggtggttgtgattcaattcaagacttggcgcgcgttcttgacgtgcgccatggctggcggccgtgagctgctgatcaagttgttctagcgcctcgcgatggcttgttgggatctcatggcgatcaaaaagcctcatcgcttctgtcgtggtgttgtgtagcgccgcgataaagtggacgtcatcgcgcagcgaaattccatattcaggcaacgcttggcgcaccgcctgatcatttagcaatgctgctaacgtgcgagcgttgacttcgccgctttgaccgcagcaggctccacaatccagccctgcacgctgcggattattttgcgtctgtgagccgtgccccacgagtagcaccaagcgtgcttgctcggtggcgatccccaacgctcgcagaatgttggccgccatttgagcacgctgcgctaacgtctgtggatcgcgcgtgaattgcggtttgacactctgccactcatgttccgtaaaggcgaaacgctccaccgatgcactcaatgcagggtaggataaggtgcgtttaaggagcttggttaaatacgccaaccccgtggtttccaccagagtaaacgtggaggcggggaggtgatgaaacgcgcgccagctaaagtgtcgcttgagtcgagcacggcgacgcaaggccaatttcgcgtcttgatcttcattccctgtgctgtcagagacgatcaagctcggcgctaataagcccggtaactgtgggcggcttgcttcggtgcccaataactgatagcggatcggtaagccaaaaaagcctgcgaagccaagggtttgaatatggggtgattgcgcttctaagtggcggcgaatgacttctgaacgcacatcgatacaaaaagccgcttgcacctcgggataacttgattggggagccgactcttgtgctgatgtcagcgcagcaaaaagttggcgttgataggcgatttccgcactgcgttgccacagtagcgcaatgcgtagtgcgcgatcctcctcgcacgattggcgcggtgcccaagattgctgccattgtaaccacacagagcccataccgcgctcaccatcatcaagtaagttctcccagcagagacgaatcgccaacagatcgcgcaggtgctcatcgtgccgaccctcaaaccctgcctgccatgcgagataagcacaccaggatgcccagccactgatgcgcattaacacggcttgtaaatacgtttcttgttgcgcaggggcaatagcgagttgcgctagagtttgctcgatggcggccatagcatcctcgggaagcttggtggctttttgttttacgcttgtctcgttgagcagcagcgtaatgctgcgatcgtggatcatcgcctcacgccaagtggcaaagagtccggtttgctgatctgggctccaatcggcttgatgatggtcaaaataggcggcgcaaaattgcgaaatttgatgggtgatggcgtcattccatgcgggatgatgctcaagatcacgccggctatcgacggtgtcgcacagcaatggccaaggatgactcggcgctgtgggctgttgtaaagcggcaatcaaggtagattcgctaaggtcactgttttgttcagcgatggcttgttgcaaatccgctgattggatttgcttattttgccaacgaaggtggtaatcactgagcgtcatggtcatgggggaggcggccaattgtttgagctcggcggcggcttgtgcaaagggcttatcaatccgtttccaataagggctcaccgcaatcatgcgatccagcggccagttaggagcaatcaaggcgcagacttgttcgacaagtgtcgataatgctgggttagcggtggtgcttaaagctgagagcgaacgtggcgcattcatacgcgttctcctgtcgtcggttgcgcttgagttgatgaaagagcggtaggcagagttaattgcacgggccaatatttgaaggtcaggcgcgtaaaagtctcatcaagataaaaaccatggtaaacccaaggatagagccacagtgataaacggcttttggggtagaggcagagcagcacttgcatcagatacaaggtgataaaacagaacatcacaaagctcagcgcgagtgggctagcggggcgcagctcgggtgctaaacccgcaaacagcagatgccatacgaaatagagttgggtgagtagggcaacccgcagcacaccgaggctcaagccacttggtgtaaaacgtccactttgccaaagtagcggagcaaaacctaaggcgagaatcgcgaccaccgcattgggtagatgcaaattggatgttaaggattgccataaatggtgcagtatcaggataagcgctgcgctgagccctaccgcgagcaaagcccccacggctttaccattgacactttgtggggcttgaaaatcatgcagacgtgctcgctccaccgcttcgccagaacttaggaaggcataagctttataaagtgaatgcgccaccaaatggagcagggcgagctcatataagcctaagccgatttccatcagcataaagcccatttgcgcgcacgttgaccaagctaaacgaactttaatgctgatccgagtcagcatgaccatgccagcgagcaccgcagtgaggctaccgacgatcaccagcaaccattgcgccgaaggaacaagtccaatcagttctgcgacgcgcagcagaacgaatccccccatgttaaccacacccgcatgcaataacgccgagactggcgttggcgcttccatcacctgaatcagccagccgtgcagaggtaactgggcggtttttaagatagcagcgaaggcgagtaacaacgcagcccctgttaagctaagtggcagcgaatcctgcgcgtttaacgcgaagtgaatctcttgtagcgacaagctaccgacatcgagatagatcaaaccgagcgctaacaacaaacagatttcggcaaaacggctgactaagaattttttgtgtgccaccacgcgtgcggctttgcgctctgggtaaaaggtcaggagacgatgtaggccaacgctggttccgctccacgccagcacgatcacaagcagatgctgactggtgaccaacaaggctacgcagcttagggtaaacagcgtggcggtgacaaaacgcgcttgctgcgcttcgccttgcagataacgatgggcgaagcgggttatcacccagcctaggagcgagacgagtatcgccatcacgatgcctaatccatcgactgggactaggttgatgctcgcttgccctatcgcaaaaagggtatttccaagcatggcgatgaagccggcgagagtggcgaacttggcgatacgccactgctgttgaggtaaccataagctcaatacaaggccaccaagatacaaactaacaaggagccactggggtgacagttccgacatgggtcggcctcctgattgaaaaataagatgttatcggtggcgctattgtggttgcgaaggaatgagtaagtaaaatatattgttattaacaaaacgttctataaaagagaacaaagcgatgcgacatctgaattttcaccatttacattacttctggactgtggctaaagaggggcatctcactcgtgctgcgcagcaactcaatgtgtcacaatcggcgctttcttcacaaattcgtcagttagaaggtcaattggggcatgatctgtttgtgcgccaagggcgcagtttgcagctcaccgaagttgggcatttggttctggaatatgccgaaagcatatttaacttgagcggcgagctgctttcgatcatggagagcggtgaattacaacgggtacagcaattaaggattggctcggtggcgaccttatcgcgaaactttcaggaaaactttttacgccctgtgctcggtaaatcggatgtgcggcttatcttgtcttcctctaccttggaagatcttctaggtcagttacaaatgcataagctcgacctgatcctttccaatcgtccggtaccgagtgactcaacgcagccttggcgttgtaagcgcattgcacagcaaagtgtctgccttgtcggaccgccgagcgacactttgcgccgttatcaatttccgcaggatttacctaaagtgaaaaccttggtgccgggggcaagcagtgaaattcggctgcaatttgatctgtattgtgaacagttagggttagcggtaacgccctacgctgaagtcgatgatatggcgatgttgcgtctattggcgcgcgatgtggaaggcgtcactgtggtgcccgaggtcgtggtacaagatgaaattgaaacagggaggctgtgcaattacggaacactggacgcggtgaccgaaagcttttacgcgatcaccacgaaacgccattttgatatgtctattgtcaatcggttgctcgacaactagttgcaattataggttgtagaccttcgcgccatagaaaggaggccgggcgctcggtagctgacaatgccatacaattctgcgacagatttgttacagagagagggttatggtgtcgtgcataaccaatttatcaataacatggcgatgtactgcgagacaagacactctattttggcggctattcaggctaaccgacatgcccctgcattatgggttaaacagaaaacctacacctatcaagagatgaccgatatggcactctcattgagtgactattggcatttacagggcgtgcagcgagttgcgatcctttcggtgcgcgatctcgcggcttattctgcgatatgggcgagctatttgggcggtatgacttatattccgctcaatgcgcgagcaacaacagaacagatccaagagacgctgatcgcgacacaatgtgattccatcatggtagacgcgcagcaattgagtcgtttgtcctccttactagagacttgcattgaccgattacacatttatgcactgcctgatgtggatgtggaaccgttacgtcagcaatatcctcagcacacttttcacacagtgcaaataaccgaacaagatgtggaattactggtagtgaaataccatttagacaatgaacatgagtacgcttatatcatgcaaacctcaggttcgactggtaaacccaaacgtattgcggtcagctacagtaatttgcattgctatatcagtcaaattgacaaactatttccactcaatgcgcaagatcgagtggggcaatattctgatttgacttttgatctttcggtacatgatattttttacagtttgatctctggtgcttgtttatatgttgtgcctgaattggcgaaattaagtccagcagaatttattcatcaccatcaattaacggtatggctttctgtgcctactgttattgagttggccctacaaagacaaaccttaaccccacacagtttaccttctctgcgactgagttttttctgcggacaagccttgctgcatgatttagccgaacaatggcaacaggccacccagcagccggtgatcaatctgtatggtccaacagagtgcacgattgccgttacctatcatcgatttgtcgcccattcaggtatggcatcggtgccgattggtcgtgcttttgaagaggagtgtttagccatcatcaacgaacaaggcgagttgatgcgctttgaatctgcacccgaggggtatcgcggagaattacttctgtcgggcaaacagttagtgaagggttatctgaatgatccgctgaatacgcaaagtgcctttttccagcacgaagggcgtctttggtatcgttcaggtgacattgtcactaaatcaaatggcgtgctgattcatcttgggcgccgcgatcaccaagtgaaaattgccggacaacgggtggaattagaagagattgaaaccgttgttcgccgcgtgactcaagcgcacagcgtggcgattgtgccttggcctttaagtgagtcgggctatgccagcggcacggtggcgtttgtggatacccatacccaatggcaaccagatctgtggttgagccaatgcaaacaacaattaaatccgacttttgtgcctaagcgttggtatgccattgaacaattaccaagaaatgccaatggcaaaaccgatattaaagctttacaacaacaattagcgagtcagacatatgaaacaagccattgaaaatatccttattgagcgattacaaaccagtattgagggtatttcatcgatactcaccaataaatttttcgatgagtttgattccttctctttcatcgatattgtcgccaaagtagaaagccagttttcggcacaaattaatctatttgatatgccattaaccatggaatcgtcagtcaatgaagtcattgattggttagtgagcgaagtaggggaataacgtgcgtattttttggttaaaagcgttaacctcaggtttattttatttaccactgtcgataaaaaatggtttatgccgcctcgtggctaagccgataagtcggaaaaaaatggcagcggctttaacgcaacttaattacgcgttacctgatttgggtgacgtaaaaaagcaggcgattgttgagcaatccacgcgcttatcattgaagaatttactcgggttttgccatcttaagcgttaccaatatcaagttgaacagcctgacttggttcaagagatcctagataaccaaggcggcggtattatcgtttgtcctcatatgggcgtttacgatggggtgacttggtggcttaaccagcaaggtaaaaaagccgtcaccatttttggtgcgggcagttcaggcgatcgtccagatgaaaatgccatgatctcccaagccgcgaaattagccggagttccctatctgctacgcaagcaaaacttgatgttggagttagcacagcggatcaaacaaggtgaatgggtggtgttacatacggatatgcgaacggaaggtgtgcctgttcgttggtttgggcaagccacacaattatcggcaacgccttttttccttgcgcataaactcgcatgcccgatctattttcattatgcgctcagtgaggggatgacgcagagactgcatttctcgcgctttgccttgcaccaaaccgatgacttaagtcgcaatattgcgcaggatgcgcagcagttagccgacatgatgcagcaagcgatcaccgcgcatcccgagcagtggatctggctttatcggcgttttaagtaaaagcaattcggtgtatctaagaagttgatgtggatgattgagcgccacgcgcgattcgctgattcatcacacaaacagcctcgataatcccttgacctcattaggggaatgcttcataaagcacccctgatacgcgatttatcgaggctcttaatatgtccatctcaactcaaattaccttttttgaatttttgacccccttggtggcctctggccagaagaccatcaccatccgtgataaatcggagagccattacgtgcccggcactcgcgttgaagtgttcactttagaaacccagcgtaaagtgtgtgagatagatattctggcggttgaaccgctcaagtttgatgagatcaacgagtttcacgctgagcaagaagcgatagaattacccaaactcaaggcgttgatccaagagatttaccccaatatcgatgagctgtatgtcataacttatcaactagcgaaataatcgagcgcaagaattatggtgaaataagcatgtcgaatacacaccaaggcttaaaagcggtcgcgattttagagtcggccaaagggattgtgtcgctactgttggggttagggctgcaccatgttgccggcgatagcctacagttgttgttgctagatctgttacagcacttgcaccttaatcctgccagttattggccagagaaattactgcatcaagcggggcttttcacccatttcaatttgaactgggtggccgcaggcgcgctagtgtatggtgcgattcgtttgattgaagcttatggtctttggcacaacttattgtggacggagtggtttgcactgctcagcggagccatctatctgccatttgaagtgtatgagttgtttacccatcctggtgtattcagtatggcggctctgctgattaacctagttattgtgctttatatgtatcggattatccgcagtaaagtgccgcaaaggtaagatgcaaacggcatggcgctcctatagactagcggcgccgtagtttgggacggttatccaaagaggacagagtaaaaatgaatccgattgtggtcagtgtcggtctgctgatttgcagcaatgtgtttatgacttttgcttggtacgcgcatcttaaagagctgaataacaaaccgtggattattgcggcgttggtgagctggggcattgcgctgtttgaatacttactgcaagtacccgccaatcgaattggctataccgcgctgaatgttgggcaacttaaaattttgcaagaagtgatcaccttaatggtgtttgtgcctttctcagtcttttatctgcgtgaaccattaaaactcgattatttgtgggctgggctttgtctggttggggcggtctatttcgcctttcgcagcaagtttgcttaaccttgatctaggctccttatcgatcgtttagcggcataaaaaccgtaatgatatctagaattcgcccctccaatgaggggcgcattcttttatagctaaggttttatggctaaggttttatgactagggttttatggctaaggtttaatgggcaatcccaccttgtgtgagctttttcgggtcaagcagcgcttcaagcgtggcgcgatcaaggtccgtctcttccgcagcgacatccaaaatcgcgcgaccttgctggtaggcttttttggcaatatcagccgctttgagataaccaatgacaggattcaaggcggtgacgagaatcgggtttttagccaaggctttttccagattgtcatgacgaactttaaaggttgcgatggctttatcggcgagcgcatggcaggcatttgtcaataattctattgattccagtaggttgtgcgcgatcacaggcagcatcacattaagctggaaattaccggattggccagccacggtaatggtagtgtcattgccaatcacttgcgcagcgaccatagtcacggcttccgggatcacagggttaacttttcccggcatgatcgaggagcccggttgtaagccttgcagctcaatttcccctaaccccgccaaagggccagagttcatccagcgcaaatcgttagcgattttcatcagcgcgaccgcggcggttttcaactgaccagaaaggccgaccacgcagtcttggctgcttaggttatagaaaaaattgtcgctgggctgaaaagcaacatgactcaattgactgaggttatcggcaaaaatacgtgcaaaacgcggatccgcattaatgcctgtgccgaccgctgtgccgccttgcgccaaggctttgatgggggaaagcgcatggctgatgccttgcgcggcgtggtcgatttggcttttccatccacccagttcttgtgcgaaagtcacgggcatcgcatccatcaaatgggtgcggccagttttgaccacatcagccagctctgactgtttatccgcgagagtttgacttaaatgcgccaaggcggggagcagttgctgctcaatattgatggccgcactgacttggattgctgttgggatcacatcattactgctttgtcccatgttgacatgatcgtttggactcaccgcatagcccaattcacgcgaggcgagggtggcaatcacctcattggcgttcatattggagctggtgcctgaacctgtctggaaaacatcaatcgggaactgttttgcatactggccatcaatcaccgcttgcgatgcattggcaatcgcttgggcgatgtccccttctaaatgacctaactgcgcattggtcatcgccgccgcttgtttaatgtaggcgagggcagcaataaacgcgctaggcatggtgtagcggcttaacgtaaagttatctacggcacgttgagtttgtgcttgataaagcgcatcagcagggactttgacctcacccatgctgtctttttcaattcggtattcgcgagtcataacagatccttttggttaatcaagcggggcttgaattcgttgtaattgttgtttgagttggcgtaaacgcagttcaccgttatccacttgttgataacatttgttgagctccatcaagaggatatagatggaatcaaggcagacgcggcggaaaatgcggctacgtgtagggtcttgaatggcatctaaaaaatggaagtagatttggcgtagaaacagttcacacagcaggaagttttgctcttttgaaccttggtaatggtgtgaggcgagtaagcgcgcacaatgaatgtaatcatagatcacttcgggttcaaaaccgctctccacctcatacgctagaaatcgatcctgcgccttaaaaaaggtgttgtataaccacgttctgttttccatatcccccccttctttatttaaatgataattattatcacattactgctgattgcaaccgacttttgcgtttatggacgaaaaaagcagcccaacccgaacaggaatggcgaatcgtgtatacccttcctacttgaagctgcagcagtgttggctacgttcgttcaccccaatcacatagtgtatctatgctcatggggatgaactcacttgccgcctacctgcaactccaagtagtttgggtatataaaaatccttggactatggcgttgatggtttgatcgatcacttaaggcgttatttcttatccctatcaggtaatgttttgtcattatttctctgagtttagatacaccttttctctcggtttccctcatcaaaattgatacaaatcaaatttgtctggcacgggcaatttgcgctgcgcggactaaaccaatccagtaccaatgacgtatgagtcactaaagatggtggttagtgttaaccccatcactggtttgtttcattttttgaggaaaagagatgttagataccctcatgctgtcgcggatccaattcgctgccaatatcagctttcatatactgtttcctaccatcaccattgcgttgggctggatattggtgtttttcaaatggcgttatttacgaacacaagtcagtgaatggctcgatctctactatttctgggtaaaagtgtttgcgctgacttttgctcttggggtggtgtcgggcattaccatgagttttcaatttggcactaactggccgggctttatggagcgggtgggcaatgtggcaggtcccttacttggctatgaagtgatgaccgccttctttatggaagcgacatttcttggtgtgatgctgtttggccgagggcgtgtacccgaatggttgcacacactatcgactgtgctggtggccgtgggcacaagtttatctgcgttttggattctggtgctcaacagttggatgcacactccagccggttatgaagtgattgatggcgtggtacatgtcactagttggaaggaggtgatttttaacccctcgatgccatatcgcttagcgcatactttgctggcatcggcattgacggcaagttttttgattgccgggatcagtgcttatcaagtgctgcgtaatgctaagcatcaagccgccaaaatgggcttaaaagtggccgtgagtgtggccacgttagcgattcctgtgcagatcttggtgggagatttacacggcctcaacaccttagagcatcaacccgcgaaaattgcggcgatggagggtgtatggcagaccgagcgtggcgcaccgctactgctgtttgctctgccaaatgaagagactcgcagcaatgattttgctcttggtattccgaatttggccagcttgattttaacccacgatatgaacggggaaattgttggacttgatgccttcgcgccagatcatccccccgtcgcaccgctgttttttggttttcgcgtcatggtgggagtgggcgtgctgatgctgttggtcagttggtttggcgcttggcgtgtatggcgtaacaaaccgctacccaaaccctatatgtatgccttaatcggcatgaccttttcgggttgggtcgccacgattgcgggctggtatgtcacggaaattggtcgccagccttggttggtgagtggtgtattgcgtaccgctgaagccgtgacccccgtagccagtagctcggttgggatctcgctgacgctttatctcatcacttatgttgtgttgttggtcgcttatgttcacaccctgttttaccttgcgcgtaaaacaggacacgcaccgcaagtttcaccaagctctacaaaggccgcgttatgatgcagtatttgccagaaatttatttgttgttgttggggttcaccgtgtttatgtacgcggtgttggatggttatgacttgggcgtaggcattttactgccgcgtaatgatgtggcgcagcgcgatcgaatgatcgcctcgattggcccattttgggatgccaatgaaacttggttagtgttggcggtcggtatcttgctgattgcctttcctacggcacatagcctgatatttactgagctttatctgccgactgcgttgatgctgattgcgcttatcatgcgtggagtcgcgtttgattttcgggcaaaagccaaagccgaccacaaagatcattgggatctgtgctttaaaatcggctctctgctggccgcgcttacccaaggctatatgattggccgctatgtcgtcggatttgaatctgcgcctgaagcttatgcttttgcggtgttaagtgcactctgtgtggccgccgcctatgtgtatattggtggcgcttggttggtgctcaaaaccgaaggggagctgcaagtgcgtgccgcgcgttggtcgcgtaaagcaggatggctggcggcgttaggggtgctgtcggtcagtttggtcaatccatgggtgaattctgcagtcgcagaacgttggtttagttttcctgaggtgatcctacttgcgccggtccctattatcgtttttgccacgattttagtggtggatcgctatctcaaacgcgtaccgacggtaaatgatgccggtgtgcaatggcctttctttggtgtggtgctgatttttggattgagtttcctcgggctcgcgtacagcttctttcctgagatcgtccccggaatcatgactgcgcagcaggctgcgtcatcacctgaaaccttgatggtggtggggattggtgtggtgatcgtcatgccaaccattctgctgtacaccttttttgtgtatcggattttcaaaggcaaagcgaccgatctaagctatctgtgacctttactacacttgaatccaaacaaacggcgcatcacgcgccgtttgttttatccgcaccattaggtggtagttaagcagtgggctcatcactgacgacttgcccatctcgaatggtcacaattcgcttagtacgtttggctagctcattatcatgagtgacgacgataatggtgcgaccttcgcggtgcagttcattgaacagcgcttcaatttcggcaccggattttgaatccagcgcaccagttggctcatctgccagcagaatttgtggctgattgatcagcgcgcgcgcaatcgcaacgcgctgtttttgtccgcctgacaactgattgggtttgtgatctaagcgatccgcaaggccaactcgagtcaagagttctgtggcgcgtcgacggcgatctttggcttttactcccgcatacaccaaaggaagggcgacattatccagagcactggcgtattccaataggttgaagctttggaacacaaaaccaatcttttgattgcggatcgcagccagttgttgagtgcttaggctatcgaccggatgtccgtccaattgatagcggcccgcggtaggtttatccaaacagcccagtacgttcatcagggttgatttacccgatcccgaaggtccgagaattgccaagaattcaccgtgacgaatggttaagtcgacgccatcaagcgctttaaccacgttttgcccactggtgtaatgtttacaaatttgctgtagctccaccaaaggagcaggagataaagacttcattattcactctgtaatgcttgtaacggtgtcactttcgccgcatggttggctggcaaccacgccgcaacaatgcccatcacggtaatggtgacaatcactatcacaatgacgctaagcgacagctctggaaccggttggcctaagtggtcataaatcggattgccctgtaaaggaatggcggcgagtaggcgaaccatcgcaaatgtcacacctaagccggcaattcctcccatgcccatggtgatcaaagattgagccaaatagtggcagcgaatggtattgggggttgcacctacggccatgcgtacgccaatgtcgcgtgtggcccgcttcacggtagcaaacatcacattggtaatgcctaaacttgccacggctaaagtgataaacccaataatgccaaggaagctttgtagtctcagcagaaactgctgcatacttttctggctcaaaaagtggtcttgcaccatgacaatttgctgatcttgcaagctggcggcgtatttgcgttttaacacttgctgtaccgtggctgccaacgcttgacggtcactgcccaccctcggttcaaggttaattccgctgatcgcttggttggggtgaaaacgctgccaagtactgaatggcgtaaaaccactgtaatcaataggtgaaccctgctcaatgttgccgctgtttttggccagcactccgatcaccgtaaattcgtgtgcgcctattttggcaatctgaccgacaggatcttgctctaattcgccgccgctaaaccagtcgccctcttgctgattaaacagttgtaccgcgagttgataaccgagcacgaccactttacgttgctgtgtttcatcaacgggattaaaccagcgcccgccgggtaacaagcgcagtttattcatcgcctgatactcacttttgaccgcgtaaggcatcatccatgaacgcttatctgcaaacgtgatcagctcttgccactcggccgaaggaagtgcgtgtttgaccataggcagagcggccaagacttggctatcttgctcggtgagagaaagcgcttgcccctcatgaaaacggccatgggtttgcgtggcataaccgccgctgacatgaatcaggttaccattgccattttggatggtgcgtacaattccactgcggatcccttcaccgaccgcaagtaaccctgcgatacataaggttgaccacgcaacggccaaaatagtgaggctcaatctgagcttttcggccgccatttcctgcataatttgtcttattggcaacatgcattaactccgactactgagcgcaatgacgggctctaattgcgccgctctgcgagctgggaagtaggccgccgctaaggctaaaatgctggtcaccaacatagaaagccagacggtggtcgaagtgatcaccggctcgccaagccacgtgggtaggccaaggtgattaagcagcaacacgccaaagtaggccagcagtaagccgactaacgccccgatgaccaccagcagcaatccttctaataaaaactgctgttgaattcgttgcggtgtagcaccaatggctaaacgtactccgatttctcgcgtacgctcggtcaccgctaaaaacatcatattggcaacgcctaagatgccgacagccatagtcatcatgccactggcggcgagaaaggcttgaattcctcgtaaaatggcagtgatcaccgcaacaccactgccgaaatcggggagaaagaccgcctcttgatcctcaggtgagaaatgtaaccgctgagcaaaagtgtgacgtaactgctcgcgtaacgcccagctagaaacaccttgtgcgggcagtaccaacatcatgttcggttgggtatcccaaatgtctttaaatgtggagcttggaataaacactttttggttatcaccaaatgaaaagcggctgctttcatcatccataatgccaatcactcgaaaagcgatgccacgaattttgaattcatctccaatcttaagctggctggtggctgcaacgtgatcgccaagaatggccacacggcggtggttgtgttgatcatgaaggctgaaatctcgtgaacctaaggtgagttttaatccagcaagagagaaataccctctatccacaccactgaccatactaccaatcgctgtccctcgctgttgggtgatggagacttctcgattctcatagacgatggagtaacgctggatctccggacgttgtgcgacttcacgcattaacgattcggtcagttgaatcgggcgtctcgcaggcatgccttgccacacttcgctggtctggccggaggcgaccatttgtgtttcttgcaacagaaagcgaaaggattcggtttgagcacgataaaacccttcgccgagcgccatcaagatcaccacagaaatcaccccccagctaatcgcggtgatcgccaatacgcttttcaggcgatgagcgagcaaagtttgccaagattgctgtaacaagaggcgcattaacgaaaggctcctgaaagctgagcgatggcattatcgttcaactgacctgttaatttgagtagctcaatgcgctgacgccaatagctataccaacgactggccagattatgtttggctcgaaataggctgttgtgcacatcgattaaatcggaggcttcggctaagccagcatcaaacagttgctgtttactgcgcagcactttatcgcgatgggtcacttgctgatccgccatggtaatttgctgccattcaatctcaacctgctgaatttgttgacgcaaattttgatgtaatccgatctcgactttgcgttgctgttgctgagccatcaaccagttgagatgagctttttcgttatcactgcgggttgctccatttaaatcaatcgggatggagagcgtgagaccggcattgaattcaccgtttcgttgatcgccgtcttgatagcctgcagaggcgcgcaaactcggataatacccactttgactctgctgcttagcaatttggctgatcgccactttttggatagcaatcaagagctcagggctatgatctttggcggcggtaagccagtcatccagttcagcactgaatggccaactcggtgttggcgtctgggtatccacttcatccacttgcggggctgaggcattgatcagtattgagagttggctgcgtttggtttcgagttccgcctgcgcattgagaatggttgactcttcatcaagttggttgacgcgtagctcttccaactccacagattttattttacccgccagataacgctgttcagcgatggctaataattgtgcgccatccgcttgtttttgctgggcaagagtcaaattactttgcgcttccgctaaggcaaaataagcactgagtaactgatgagcgagttggttataagcttggttacgttcaagttgggccaacacccagtccgcatcggctttatccaacgcgctccattttcggctatcccacaaggtttgctcaatggtggcgccataactgctcgagccattttggctttctgaccagttcattccggcactgcctgagagtgaaggaaggagatcgcttttggcgagatacttatcttgctcgctgagctgcaccgagagttcggcaatgtgtgcatcgggtgattgttgcttggcttgctgccacgcttgctcgatggagagcgcaaaagcagaagaagatgccatcaggctagtcagtacacatgcggtgagaaagcccttattcatgctggcctcccagcatgctgttatccactatgctgtctttttcggctacgccttctaagatctcaacctgtacgccgtcagaaagcccaagcttgaccggatgagcggtatagccttgtgcagagccatccgcaatcagcaccatgggcgtttcgccctcaaactgtaatgcgcgctccggaagggtaataacatccgcggcacgttgtaaggtgatttttgcgctggcagagaatccagaacgtaatgtcatgttttcagggatgtctaattgtccgatttcgacttgaaatccgttatcaaaactttttccatctttgttttccggattatttaagcgctccgattgaatcgcgactttggtcaactgaccattgatcacctgctcagggtagggggcaacggtaatactggcgggcatgccggcattcagctgcgcagcatcatgttcactgacactgcctttaaacacgatatttttcatatccgctaactggatcatttctgttgccgcttggctcgactcggtagagatgatcggctctccgacctcgactttgatatttaaaatcgtgccactgatcggggcatatagagtagaggagagcttggcttgcccaatcgaagcttcaccgctgcggatcaactctaggttttggcgtttttgctgcacttcggcttgcttagctttgacgtcggctttcgcgcggacgtaatcatcataattggcaggaatgatttgctgtttcactaagcgctcaaggttggctaagcgttgtaagtctgattcaagattcgcttcactttgcatcagttctgtggaggcatcggtcaacgcctgtggtgttggattcggacgaaccttaatcaagggttgtccttgctcaacatgttgcccttcacgcacataaatttcaccgacaataccgttgatttgcgatttaattgccaccgaatgtgaaggcatgatttgaccaaccgcgaccgcctgtttctctattgttccccggctgacgttgagggtcggtaatggggatgaagactcaggggtataagtgagagtgtaataaccacctgccaagccaacacctactaaggttgcaagaagtgtccaacgttttgccataaaaaactcatttatttcatcaatcaattagagacgggattcagactaaggatgataaggaaagttcaaaaaaacgttgttttttaacatgcgaagggaaaaataaaaagccctgtccatgctgtatgaacagggcttagtccgtgagaatagaagagatagagaaggtcgtctaattagtgatcaatcatatctgcgagaatcattgccgcgtgtgtttcaaccacgcctgaatcgaaaccgtacatgtggccatacttgtttgccagtgcggtatgtacattgttagtgatctcatcttgccagcgtttgaaccaaacaaagtggttaccgtcactcaacactggagtgtagggggcgacttctagctgcttgcccacttcagttctgatgtccgcaatatactcaagcagatcttttacatcctgtttcgaacctatattgccatggccaccgttaataaagtcccactgtttgctcagcggtttgctcagaaggctttgtagatcttcttcgtaaccgtggaaatgttctgctcccgcgaaattgtaaaacggtagttgatcgggattaatcatgtccgcgaaatgcaacacgcgatcgcttgggatcagaatcatggtgttatcaggtgtatggccagagccttttggtgccatcatcttgattttcattgagccaaattgaaccgtttgaggcttcgtcaggtcgtatatgtcattcggcgctggaactttcggggttttcacaccgttttcgcctacttcggcgtgttggttgatcttgtccgcaacggtttggctagcaataacgcggattttatctacttttggataatttttcttaattaagtcaaccagttggttgccaccacctaaatgatctaagtggtagtgagaatacataatcgtagtgatcggtttattcgtgatggattgcacccctttaaaaagcgcatcaatacgaccatcgcctagtgggtcaatcagcaagacagagtcttcgttaaccacaacggtagcgttgtaataattgacccctatccagtaggtattcttgcccaatttttgaacggtggcttggctgttatcaaactggcgctcatacagattattaattttttgtcccagtttcagagactgagtcgcagaaggctcaacttcgactttcacagtgtcttgaacagtttcaccagggaaaaaaatcgcgcgttgattgtcgtggtcatggcctttagcacttgcattaaaagtaagtagtgctgcagtaataggggctaaagctaaggtggatagtttcatttttctctcctcaatcaggtggggaaaagataaatgagaaacaaacatatcaaaaatgcatgcttgttatagtatgtatatcatttacgcacgaaattattaggtgatgagatggtcgcccccgaaatcaatttgcgcagcattgatttaaatttattaacgattttagaaaagttattgattcataagcatattagccaagccgcacaagcattgaatatgagccaacccgccgtcagtcgagccctcatgcgtttgcgtgaacaatttggtgatccactgctggtgaaagtaaaaaatgagtaccgattaaccgcaaaaggtgagcgcctctgcagtgaactggagagaacgctcaataccattcgacacatgttggtagatgacaagtttgacccaatgcactattccggtgtgttcactattggtgcattggatttcgagatgatgatgattgtgccgaaattgttggcgcgttttcaacaacgtgcccctaatttgaagttacaaatcgtaccgtataacgcctatatgccgctgcatgattacttggaaaaggtggcggatttactgctgtattccactgatgagtcacccaccaatgtgtttaagcagcgtttatttaatgacaactatgctgtggtcatgtgtagaaaccatccattagccaatcaaccgataacactggagagttattgccagagtcgacatgtgatcatttccggtaatggtttaggaaaaacggatatggatcatgagctgaaaaagctcaattatcagcgcgaagtggtggcatcgttgccacatttttcgatggtgccggagttactgatcaacaccgatctgattgccaccttaccaagacgtttggtgactcacttaggccagcgttatgagataaccgtggctgatttacctttctatactgccgattttcgagtggaacaattttggcatcttattcatcacagtagcccgattcatcagtgggtgaggcaagagatcaaaaatttagtctatgaagagatcgataagaaataatctcctatcaaatttaaaacaaaaggctgccattcggcagccttgaaagggatggtgagatggattacaccagatcaaatcgatccgcattcattactttggtccatgcggcaacaaagtctttgacgaatttttctttgttgtcgtcctgtgcgtacacttccgcataagcacgtaggatggagttagaaccaaacaccagatcaacacgagtggctgtccacttcactttgccgctcttacgttcaacaatctcgtaagagttgcgaccagttggtttccaggtgtaactcatgtcggtgaggttaacgaagaaatcgttggtcaacgcacccacgcggtcggtaaacacgccgtgttggctgccaccgtagttagtgccaagcacacgcatgccaccaattaacaccgtcatttctggagcggtgaggcgcagcagttgcgctttgtcgagcaacatttcttccggtgtgaccacataatgctttttctgccagttacggaagccatccgcgagaggctcaagcacttcaaaggactcaacatcggtttgttcgattgtcgcatcgccgcgtcccggtgcgaacggtacggtcacattcacgcccgcggctttagccgcttgttcgatacctacgttaccagccagaacaatcgtatcggcgatactgatgccagattcagcggcaattttctctaataccgccagaactttaccaagacgcgcaggttcgttgccttcccaatctttttgtggagcgaggcgaatacgcgccccgttggctcccccacgtttatcagaaccacggaaagtacgagcgctatcccaagcggtgctgaccatttcactgatgcttagaccgcttgccgcgatttttgctttgaccgcattgacatcataatctttacgacctgctggaacagggtcttgccagatcaaatcttctgccggaacatctgggccaaagtagcgcgcttttggtcccatatcgcggtgagtgagcttaaaccaagctcgcgcaaacacttctgagaagtaagcgggatctttgtagaagcgctctgaaatcttgcgatattcaggatcgattttcagagccatatcggcatcggtcatcattgggttgtagcgaatacttgggtcttccacatcaaccggtttatcttcctctttgatgttgacaggttcccattgccatgcacctgcagggctcttagtgagctgccattcatagctgagcagtaagtagaaatattcgttatcccaacgggttgggtgagtggtccatgcaccttcaataccactggtgacggtgtttcgaccaatcccacggctggtgtggttgttccaacctaagccttgttcgtgcagttcagcgccttcaggatcagggccaaggttagaagctttgccattaccgtgcgctttacccaccgtatggccgccagccgtcagagcaacggtctcttcgtcattcattgccatgcgagcaaaagtgacacgcatgtcttgcgccgttttgagtggatctgggtttccatccacaccttctgggttgacgtagataagccccatcatgacggccgcaagtgggttttcgagatcgcgctgaccagagtaacggctattttcaccgccagatttggcaagccactctttttcagaaccccagtaaatgtctttttctgggtgccagatgtcttcgcggccaaaggcaaaaccaaaggttttgaggcccatcgattcataagccatgttccccgcgaggatcatcaaatccgcccagctgattttgttaccgtacttttgtttgataggccacagcaaacggcgtgctttatctaagttggcgttatcaggccatgagttcagtggggcaaaacgttggttaccggtaccgccgccgccacgaccatcggcaatacggtaggtacccgcagagtgccatgccatacgaatcatcaaaccgccgtaatgtccccagtcggccggccaccactcttggctattggtcattaacgctttcagatcgcgttttagcgcttctacatcaagctttttcagctcttcgcgatagttgaaatcagcaccaagtggattggttttgctgtcatgctgatgaaggatgtctaagtttagcgctttaggccaccagtccatgttggacatgctcgccgaagtcaagccaccgtgcatgacagggcattgaccgcttgaacccgctttattgtgctccattgattactccttgcttcgcattattccctttcagttgaaagttgctgcgtgttggccattttcatgagacccgcactcatattggtgtaggtgcacagttggccattttgcggcaaccccaagtgtctggggattctttgatgaatttcatcactcgaaagcagaaaatcagcttgtattcgaatgagttgagatactgtgttgacgtttagagtctagacacggatccccactaagactaattagaattgccgatacttgtgataggtaacattgaccatggtcatattgcggacattttgttttgtaaccggtttcagaaactggttacattgtaaaaaagtttaagttatagtgtcagcagtttgaactggctaaaaatgaattgccaattttgtgagagaggtcatctatggctaagtctatttttcctaacgattttttgtggggtggtgcggtagcggcgcatcaagtggaaggcggttgggatcaaggtggtaaaggcgtgagcattgttgatgtgctgactcgtggtgcgcacgaagtgccacgccgtattaccgatggggttatggaagacgaattttacccaaaccatcaagcggtcgatttttatcatcactataaagaagatatcgcgctgtttgctgagatgggttttaaatgtttccgtacgtctattgcgtggacacggattttcccgaatggcgatgaagccgagcccaatgaagcaggattacagttttatgatgatctgtttgatgagctgttaaagcacaatattgaacctgtcattacgttgtcacattttgaaatgccactgcatctggtaaagcagtatggcagttggctcaaccgcgacttgattgatcacttcaccaaatttgcgcaagtcgtgatgacccgttaccagcataaggtgaaatactggatcacctttaatgaaatcaataaccaatgcaactggaagctgccgatctttggttattgcaactcaggtatgctttacgctgagcaagaccgcccagaacaagccatgtaccaagtgctacatcaccaatttattgccagcgcattagtggtgaaactggggcacgagatcaatccggattttaaaattggcagcatgatccatatgatgccgctgtatcctgccacctcacgtccggaagatgtgttgttggcacaagagttgatgcgtgagaaatatctgttcagtgacgtacaggttcgtggctattaccccagttatctgcgcaaagaatggcaacgcaaaggcatcgaaattgagatgcaagctggtgatgagcagatcctgcgccaaggctgcgccgattatctcgccatcagctactacatgaccaacattgtctctgcagcgccagaacaagagggcgaaaccacctctttgtttgaaaccagccgcttaaacccgtatcttcctgcgtccgattggggatggcagattgatccacaaggtttacgttatgcgctttctgagttgtatgagcgttaccaaaaaccgatttttgtggtagaaaatggcctcggcgcgctagacaccgtcgaagcggatggttcaatcaacgatgattaccgaattcgctacctctctgagcatatcgcggcagtcaaacaagcgatcgactatgacggtgttgaagtgatgggttacaccccttggggctgtatcgactgtgtatcgttcaccactggcgagtacaaaaaacgctacggctttatctatgtggataaacacgatgatggcagtggcaccatggcgcgcgctaagaaaaagagcttctactggtatcaacaagtgatcgccagtaacggtgaaaagctttaaatcgtgtcggcggcctttgggtcgccgcttaatttttgcggactcagtttgaaggattgttgatggcaaccataaacgatgtgtgtaaattggcgggtgtctccaaagccacggtatcacgagtgctgaatgagacaggccaagtcaaagcacaaacgcgtgaagcggtacttgccgccatgcagcagctcggttatcagcccaacagtttggcgcaggcgctcgctaccaataccacaaactcaattggcttggtgctgccgcattttgagagcagctattttggttcgattttgtttgaagccgaacaaggcgcgcagaaagctgggaaaaaactgctggttatgaacagcaaaaacagtgagcaaggcgaaaaagaagcggtcgccacattagcggcgcagcgttgtgatgcgatcttgctgtacagtcgtcatttgaatgaggtgcaattacttgaattacaacagcaacatccatcgcccttagtgatcctcaatcgccgtttacatcacccgcaattgcacagctttgggctcgatcaaacgcaaattgcccagttagcgatgcagcatttgttgaatttagggcatcgtcaaattgcctgcattacatcgccgttggtgagcgagacgggaaaaattcgttatcaggtctatcaacaagcgttacatgagcaagggatagagttgagctcgtccttggtcattgaaggggataacacgctgcttggtggttatcaggcaatgcaacaactgctgcaacaaggcatttccatgacggctgtttttgcctgtaacgatgatatggcgctcggtgcaatgcgtgccatgcatgaacatggcattcatgtacccaaacaagtttccataatcgggattgataatgaacccgcggcggcttttgctatcccgagtttatcgagcgtgagtctaccgatcggcgagttaactcagcaagcaatcagtttggctgtcgagattgctaataaaaaaccacaagatgcacagcacaggctctatcaagggagtttgatcgcccgtgaatccaccatagcgctcaaactatgagtaaaacagcaacgtgtcagtaaaattgcggggacagagcgcgattttacgcttcatcttggctatcctgctccccgatatagataagtgaagaggcgacatgcttcttcgcgaataacgtaaaagagaacaccatgacaatacatcgtattaatccaggcactcgttggtctgacatcaccgtgtttaatggcattgcccattttgttgaagtcgccgatagcgacacgtcggccgatatgcaaggccaagttgagcaggttctcgcgcaagcagagcgccaattggcgaagattggcagcgatcgttcacgcatcttatcggtgacgatttatgtcacggattttgccgacctcccagtgcttaaccaaatttgggatgcgtggttcccagaaggttgcgccccaagccgagcgtgcgtgaaagcggagctggctgacccagactataaagtggaaatggcttttgtggcggcttcgggcgagcagtatcaataaggaaacgccgatgtttattggtcatatcacgcagcgccagttttgcgctgcattgtcacctcagttgcaacggctgattaatgaagtattacagcgtgtagcggcaccactaccaacaggtaaacacgagttgcagggtgattcggcgttttttctggtgatggaagatcatacccaaccgctcgctctgcgtcgtagcgagtgccatgctcggtatctcgatgtgcagattttactgcaagggcgtgagcgctttggttacagtctcgcgccgttcagtggcttggacgaagatttgctggcaacacgcgatgtggcgttcagtgcacaactggtcgaagagcgctttgtcgatttggcggcgggagatttcattgtgttctatcccggtcaaccgcatcgccctttgattgcggtagaaggtgagggtgagcctgtacgtaaagtggtgatcaaggttgataaagctttttttgagtaaaaactgagtcgctgaagtgaaaccatgaaaaacgcccatttgtatgggcgttttgctgaagtccgaaagcagaaactagttgataaagcgctctgggaagtcggagaaaatggcatcgactttgtctaaatagcggaatttatccacttgattgagggtgtaacaccaaatctggtagccaccatttttcaaatcgcggatgtgtttttctgtgatccagcggtagttgaggttacagctaaacgcattcacctgtttaagcacttggcgatcccgctgagtcaaacgctcactcaaaatccccaatttataacccggacaatgctggtgcagttgcaaaataatgtcgtggctaaagctcgacagtaagattttgtcggcaaccagcgggctctggtcaagttgcgctttcaactgttgtacaacactggccacatcatgcttatcgactttgacttcaatattgagtcctaaatcgtgttcggcggcgagcaccagcagctcttccagcgtcatgatggtttcgcccgcaaaacgaggatcaaaccaagcaccgaaatcaagttgcttgagttcggcgagtgtgtactcatcaatgcgacctttgccattactgcaacggtcaatcgtatggtcgtgacacacaaccagtacattgtctttggtcggctgcacatccacttccacccaagataaaccaaggttgatagcggcttgtacactgacacgggtattttctggatacgttccagccaccccacggtggccgacgatgattgaaggcatcatgcttccttagtgagaatcacactcaaatcacgattcaataagttcgacgtggtacaaaagggacaactgttgaaaagcaggcgtacttttatcgacgaagaggcgatgcatttcagacagttcaccactgaccacgggagcataacgctctaatttgcttttgtctgcaactaaccaacactgttcgctatgttctatgatggcgcgggttaaattggcttcttctggcgtaaaatcaagcaattgaccgcgagaattgagcccgcctacaccaaaaattccaaccttaatattaaagctacgataaaagcgggttgtcgcttcgccgacggtatcttcatcggaatggcgaaccagcccgcccgcaaggtgcaaattgatgttggggttacggcttaaggtcagtgcggcattgaggttgttggtcaccacagtcaaaccgggatgatcgagcagcgcttgcgccacttgtttcggggttgtcccgatacccagaaaaatactgcatccttccggtaattcttgcgccaccctctgcgcgattcgctgttttgctgtcaggttgatcaaatcgcgattactgaacgataaattgtcattcggactgggcagggaaatgccgccatgcacgcggcgcaccatgcctttatcgctcaaatcattcatatctttgcgaatggtttgtaccgacacctcaaagcgttccgaaagtagggcgctcgaaagcaccccgtgagtttgttgcaagtattccaagatctgtttttggcggtgggataataaagtcacaagcttccttactgttgacgaattttattgctgacgagtgctagcgactttgctgctctgtgtacaagaacggtgtgactggacaaagcgtttaccttgttgatcaaaaagatgcagttgctcaagcgcaacccagatcggcagggtttgatgcacatcgagcggaatttctgcagtgaccgcgatgaaatcctgctcgctttctaagccgataattttgccatgcaccagctggttcggacctagtggctcaacgacctgaatatccaattttaactcaatcgcattggttagcgggtgcagcgaggcgtgttcagggcgaatacctagcgtgatgttttcggaactcattgcgtcaaactgtggcaagtaacagtgcttgcctgcgatgtgtagttgtccttgcttgatagatgcagggagaaagttcattgcagggctgccgataaaactcgccacaaaggtactggcaggttgatggtaaacttcggctggcgtaccaacttgctcaatttcgccctgtttgaccaccacaatgcgatcggcaagcgtcatcgcttccacctgatcatgggtgacgtaaacactggttacgccaagctcacgctgtagttttttgatttctaagcgcatgtgcgcacgcagcgccgcatccaagttcgagagcggctcatcaaacaaaaaaagttgcggatcgcgcacaatcgctcgtcccatcgccacgcgctggcgttgtccgccggaaagcttggccggttttcggtctaagtactcttcaatttttagggttttcgcgaccttagcaatttttgctgcgatggtttgtttatccacaccacgatttttaagtccgtaggcgaggttatcgtagacactcatatgcggatagagcgcatagttctggaacaccatagcgatgtcacgattggccggtttttcgttatcgacacggcgtcccgccagatgaatttcgccggaagtaatgctctctaggcccgcgatagagcgcagaatagaggattttccgcagcccgatgggccgactaaaacgataaattccccttgatgaatcgacagatccacgcctttcaccgcttgatggccgttatcgtaagttttgactaactgtttgatgtctaacataacaggctccgcgtgtttggcgctgcgtagcagatgaatattggagttctgattatttttcactttcgactaatccttttacaaaccaacgttggaaaatcaccaccaccaaaaccggtggcagcatggcgaggatcaccatggcaaacgcgtagtcataacgcggcaagctggtttcattgatgttattgagaatctgttttatgcccatcactatggtgttgtactgctcatccgtggtcatcatgatcggccacaggtattggttccaacccaccacaaacatgatgatgaaaatcgcggccatcatggttttcgagaggggaaataaaatatcgataaaaaaacgtatagggcctgcgttatcaagctgagccgcttccaacagttcatccggtatggttttaaaaaactgacggaagaaaaacgtcgcggtagcggaggcaatcaggggtagcactaagccggtgtagctattgagcatgcctaaattggacaccacttcataagagggaataatccgcacttcaagcggcagcagtagggtaatgaaaatcagccaaaaccacgcgctggcataaggcaaacgaaagtagaccaaagcgtaagcggccatcatcgaaattacgattttgccaatcgcaaaacccaagcccatgatcatcgagttaacgatcatggtttgcgcggtgacattaccggcaaaaccgaggcttttattccatgcttcgcgataaactgcgctgagattatcgccaagagtccattgcaaaccttccgagacaatggtgtttggctgatgggttgagcttgcgaaaatcagccacagcggcactagcataaacagtgcgccagcgataaggatcaaatgatcggagagtcgattacttttcatcgtaactccttagtaatgaacacgtttttcaacaaaacggaattgcaaccaagtcagcgccagcactaacacgagtaacaccaccgattgcgccgagctgccgccaaggtctgcaccaacaaaaccgtcgcgatacaccttatacaccagtgaggtggtactgccgccggggccgccattggtcatggtgtcaatcacgccgaaagtgtcgaaaaaagcgtaagtgaggttgatcaccaacaggaaaaatcccgtcggggcgagcagcggaaaggtgatgctccaaaagcgtttgctgtcgctttggcaatcgagcagcgccgcttcgcgtaccgcgtaggaaattgactgcaaacctgccagaaaatagaggaagttgaccgaaacctgtttccagactgagaccaaaatcagcgcaatcgtggcatccacagggtcggtctgaaagctaaattgccagccgatgtattggaaaaagtcggtcaggacaccaatgtgcggattaaacagaaaaccgccaatgatgcccgcgacggctggcgcgacggcatacacccacgttagcgtgacacgatacgaaccttggccatgaatgatgttgtcggcttttaccgcgagtaacagcgcgagcgccagcgaaagaaaagagacaatcaccgaaaacagcagagtaaagcccagtgagtcaagatagtcggttgagctaaacagtacctgatagttttcaaaccaaacaaaagtcgaggagagcccccaaggatcttccaacataaaagagagataaatcgcttgtgcggcaggataaataaagaacactgcgatgatcacgatttgcggcgcaagcagcaaatagggcagcggagtgtgagcgaaatgttgtcgacgttgcacaggaaaactcaaattagacagtaaaaataacaagccgccagcaaaatctcaggataatgctggcggcgtttggggttattgcacggtacgagcaaagcgattcagtaacttagcgctttcatcttcgactttattcaagctgctctcgacagttgagcggccagagaaaatgttatcgaactcgcgatgcatgacttcgcgcacttgtgggtagtaaccaaggcgatagcctttggtccattcaccatcaggcaagctaagctgctttacacccacttctgcatccgggttttcttggtagtagcccgattgtttggtcaggtcgtaggctgcattggtgacgggcacataacctgtggttttatgccaattcatttgcgtttcgggcttggtcaggtaagcgaagaaagctgcgacacctttatcctgcgctggagtgtgaccctgcagtgcaaacagcgcggcgccaccaataaaggtatgggttgggtttttggtgaccgattcccagtaaggcaggtaggtcgtaccgagattgaatttcacgcggttacgtagaccaccgaatgagccagaagagcccatccacattgccacttcgccgcgctcgaatggcgtttggttggcatcccaatcactgccgtaatacttgtagtaacctttatctgaccactctttgagttttttcacatgcatcagcatatcgtcagagttaaacatgattttcgtcgagagatcttgatagccattttgcttatcagaaagcggtaggttgtggcgagatttgaagttctcaaacatgatccacggcgttaaggattgggcaaatcccgcttgacctttttcggctaacttagcagcaacttgttctagctgctcataagtttgtggcgcttgcgcgttaacggaagccaacatgtctttgttgtagtacagcacaggcgttgagctgttgaatggcatgccgaccatttttcccgtgttatcggcataaaagttacgtaccccagcaatgtaatcttgtgcggtgaacggatagcctgactcgatcatcagatcttgcacgggtttggcaacgcctttactgctcataatggtggcggcaccagcatcaaacacttgcaaaatattgggtgcttggccagcacgaaacgccgcaatacctgcggtcaatgtttctgtgtacgaacctttataaacgggagtgagcttatagtcgctttgtgaggcattaaagtcagttgccaactgattgaccgtttcacccagttgaccacccatggcatgccaccaagtaatttcggttgccgctaatgttgaggctgaaaaaacgccagaagcggttgctgtaagcaaaccggttaaccataccttattcattgattcattccttgtaagtttcgaacgagactgtttgtgtttcgttagaaggtatagtggcgagcaaaagttacagtgccgtggctgaaaaatggcaaaaatatgaaagatttatggaaaaggtatgacagatacacgggagcatttcaccgcgaataagacgatggcgtgcgcgatttggccgccagaatagacttaagacggttacgaagcgcgaattaaaacggtaggaatggaaaacaatggttgaacttggttgataatgagagcgtttctcaatagaatcccaaccattccttaaacggctaatcacaacccatgaaaagatgtctctcacttctttgcgtttcggcacttttgccagcgcatgccgcttcgctcgatcaagcgcaagcgattcaaaacagtactaaccaagcttctgcacagagccagcaaaaaattgaccgcagtgccgagcagagtttgttactgcgtgcggaaatcgaacagttgaacgaagaagtcaaaaatcttcaggtgtaccgtaatcacttacaatctttggtggccaatcaacagcaagagatggccagtcttgaacagcaaactgaagagatcaaacgcacgcgccaaggcatagttcctttgatgtatgacatgattgaaggactggaggagtgggttgcgcaagataaaccgattcgtcttgcggcacgtcaagaacgcattgagaaactcaaagaactgatgcctcgggcagatgtcagtgatgctgaaaagtaccgtcgtattctcgaggcatatcagattgaactcgactacggcaataagcttggcacctatcaagccaaaatcactctcccttctgcacaagaagtggaagcggatgtgctctatttaggtcgtctgtcgctattagcacgcagtttggatggcgagcagttctggacttggaattccaagcagaacgcatggcaagcaatcacggatgccaacaaaagcgacctcgctgccgcttaccaattggctcagcaacagattgcgccgacactgttgaacttgcctgtttcgttgaccgctgcggaggctaaataatgacacttaaaaagaccaccttagcactggcattaagtctgccattcgcctttgcaagtgttgctaacgcatcaaatagcctcgtccaacaagcgacgcaggaaaaagcgcaacagcaacaacacaacctgcagcgtgaagcgggttttgtacaaacggcgcaagaattacaagccgcgaaagccgagttactggctgagcgtaatcgtctacagaaagaggcggatcagctatctagccagttcagtgataacgaaaatacgctcgcgcgtcttgaagaaacgctgcgtttggaaaccggtagcttaggtgagatgtttggcgtagtacgccaaaacgcgaaagaactgcaaagtgaactggatcaatcagtgactggcgttgagcctcgtgctcatcagcagagcattgatgacgtggtggccgccaaaactttaccgtcaatggctcaactgcgcggtttatggcaagccatgagtgaagagatccgtgcgagtggacaagtccaaaccaccgaaattcagtggctaaacgggcagggtgaaacgcagaccgtacctgcgttacgtttaggttcgcttggattaatttccgagcaaggctatgtgaagtgggataatgcacgtcagcaagcattgagctatcaacagttaccatccgatttcccaaccttcagtcatatccgcactttagttgatggtgacgttgtcactatgaaagtcgatccatcacgcggggtgttgctcgagcaactggcgcttaccccaacacttagccaacgcctacaagcgggtggtgtgattggtaacgtgatcctcgtgttactgggtgtgggattaattattgctttgtaccgtggcgcgatattggccactctgcgtcaaaagatcaaagcgcaactcaaaaacccagagcagccggggaataaccctctcggacgcattttggcggtttacaacaaagagcagcaacgcagtgtcgaagcgctcgagctgcgtttactggaagccgttgtggatgagcaaaatcatcttgagacgggcctgtcgatgctgaaattgctggccgcactggctcctatgcttggattactcggcaccgtgaccgggatgattgaaaccttccaagtgatcacccagtttggtaatggtgacccgaaagtaatggcgggggggatctcgatggccctagtcactaccgtggaaggcttgattgcggcgatcccactgctactggcgcataatattttgagcgcgcaagcggaagcgatccgcaacatcctcgagaaacaagggattggtcttgtggcacagcaagcagaacgtgattgtggtgccactgttactcaatctcgtgttgaacaagcagcataagggcgagtgatgaattcagcattctctttcctactggattactggcaaccgctggatgagtttatggctcaaggcggcgctgtgctctggtggttagcggtggttgttttgctctgttggctgttagtgattgagcgtttgttgtttttgagcgtgacctttcctaaacagcgccaacattgggttgacctctggttgcaacgtgcggatcaacacagctggtttgcccgctccattcgtgaacagtggctaggcgaagcgcacaatgcgctcaatcagaatctcaacttaattaaggtactggtggcgatttgtcctatgcttggcttacttggcaccgtcaccggaatgatttccgtgtttgatgtgatggctacacaaggcagtagtgatccaaagttgatggcatccggcatttcattggccacactgccgaccatggcgggcatggtggccgcattagcgggactcttcgtccatgcacgtttgagcaaaacttgtcgtggacttgaaatgaaattagaacaagcgttaaggagccaatcatgaggctagggcgcagaacgtcaaagcaagaagaagcgcagatcgatctgacttcgatgctcgacatcgtctttatcatgttaattttcttcattgtgaccagctcgtttgtgcgcgaatcgggtgtggaagtcaatcgcccgacagcggcgcatgccgtaagccaaaaacaggctgggatttttgtggcgattaccgcggccaacgacatctacattgataaacgtcaggtagacgtggagcgagtgcaagcgactttagagcatctgttgttagatcaaccggatgcttccttagtgattcaagctgatgagcatgcctttaacggcaccgtggtcaaagtgatggatgcggcgaaaggcgctggagtaaaaagcattgcattagcggcggagaaaccctaatgggacgcttgatcttagccagtccgattgcgttgttagtgacactggcgctgtttagcttgatggcttggatggtggataacggcggaaagagcattcctaaaccgaccgctgcgctcagctttactatggtcatggctgagcaggagcaagatgtacaacgcagacaacgtagcgtaccagaacagccacaagtcccgcaggtgccgacacaagcgcctgcaaaagctgaacaaacggcggcactcgatgtttcagacctcaatccggtgatggacttaaacctcagtaccgctatggaaggagttgccgttaacgcgcctcagtttggtgatttcgcggttaaccagcaggtgatgccgctacacagggttgagcccaactatccagcgaaagctctgcaacggggagtggaaggttacgtgatcttgcgttttaccatcgatgagttgggaaaaacgcgcgatatcgaagtggtggatgctaacccgaaacgctattttgagcgtgaggcgatgctggctctgcgtaactggaaataccagcctaagatagtggatggtcaacccgtaagccaacccggacaaacggttcgactggagtttaaactgaacaaatgaaacgacgaatcttaagttatctcttgctctcttgcctatccgtgacgacttacgccgcggagctgacaccgtacacggccagtaaagtggtgaaagcgaatcagctagcacaagagaataaggtgaaagaagcgattcagatcctaaaacaagcagaactcagccgcagttatgatcgcgcttatgtggcgcgtatgcttggggtgttttattggcagaatgagcaaatccctgcggcgatagcatccttgaagttggcggtagagagcaacgagttacaagatgatcaagcgtggacaacacgcaaaatgttggcggatcttttgataagccaacaagagtatcgttcagcactcaaacattactacacgctagcgcaagccattcccgccgatcaaaaagggaatgaactctggctgcgcattagtcagttgcacttccaaatgcaagagtggaaggcggtactgaatgggatgcaacagtatgctcagttccaaaccaaggatgcggtattgccactttcactacaattaggcgcacagcttaatttggaacagtggaagccgggaattctcaccctaaaacgcttattggtgttggagccacagaaaaccgagtggtggcgtcagttagtgagcctagagttgcgagttggccagaagaaagaggcgctcagcacactggcattggcgaagatgcaaaaagtggcacttaaccaacaagatttgcgtttgcttgctcagctctatgcgcaaaatggcattccagagcgtgctgcacaagtgatggaaagcctagatgaggcacagagcaatcaacagcttattactgagcgagccatctactggcaacgtgcgaaagagtgggataaagcgatcgctacgtggcgtttagcggcgacaaaagatgccaaatatcactggcatgtcgcacagttattgctgcaagagggccattatcaacaagcacttgctgaactggatcaggtcaaagagcgtgataaacaagcgcaagtcgctttagcgaaaacgcgtgctttgtataagctcaatcaatttgaggccgcattggtgcaagctaaacgagcagacagcctccaatcatcagaaagcgccaaacagtggatcaaatatttgtcgcagcagcgtcaaactcaatccacccaagactcgtagcgatgttctagagttcgagatatacctttcctacttgaagttgcagcggtgttggctacgttcgttcaccccaatcacatagtttgcctatgctcatggggattcacttacttgcagcctacctgcaactccaagtcgtttgggtatagaggcaataaacaggtgatgcagtcagctttgctatgtaattctctgtttgctcaataacgagatttaatgaactgtttcgcatcgtgaatgcttcacccttccatacatcagcgtccctaatgacaatgctgacgcattctcattagggacgtgaccatgcttatacgactgacgctcaccgctgccgcgatcatgctggcccagcaaacgctggccaatgatgggccgctggcttttattccaattacttacgccaacaactaccaacacggcattgatattttcgattactggaaaagtgagaagcttgacggtatccgcgcgatttggacggggaaacaactggtcactcgtaacggtaaccctattgctgcccccgcttggtttaccgagtcgttaccctcttattcactcgaaggtgaattgtgggcagggcgcggcaatttctcactggtacagcaaacggttttagatagccaaccggctgactccgcatggcgcaaaatcagcctaatgctgttcgatatgcctgatgcggcgggcgattacagtaagcgctattacaacctcatccatttggtgaatagccttgatctcaagcatatccgatatgtcgaacacaccccgataaaatctgaggcggaactgctttcctaccttgataacatcagtgagaaatcgggggaaggggtaatgctgcgcaaaatcagcgctcgctatcaggcagggcgaagtaatgatttgttgaagctgaaaaggcatcaggatgcagaagcaaccgtgattggttatcggctcggcatgggaaaatacaaaggtaaaatgggctctatgctggttcggaccgcagaggggctagaattttatatcggcagtggatttagtgatgtcgagcgcgccgagccgcccaagattggtagtgttatcacctaccgttacaacggacttacaacggaaggcaaaccaaggtttgcccgttttgttcgggtcagagaaaactattgaggcaagctactgagcttgcccaaccgtgatacgacaacgcgcaaacagccgctgccaatattgggcatgctgctgagtcgcaagacggaaagtttgatggctggcttgaatcggaaacggtgagtgaggttgctcaaacagaccaagttgtgctgataactggtagtaggttcgatccagtgaagcgagataaggttgtattttttcaacgtattggctttggaatacattgcgtaagtagttgagtttggtgttatcacgatgaggcccacagacaatcgcatcatcattgttctctaactgctgcgtcacaacctttaaccagacgctcgcacgatccaacgaaaatttaaagtgacctaataagcgctgtttctctagcacttcttgctgagtgactaatggtttggaggctatgggtcgctctgaaaggagttggtgttgaatcgtgttgagttgctctagtgctaacagcagctcactgtggctccattgttcatcgtaccactgcgaaccactgagttgagtgcgcatggtatcactggtgtaaagcaaattatgccaacgtgaagccagctcctgctgtttgatgttttgtatatcgagcaactgtgctttcaaggattggctaagctgcggtgaggttaagcagccttgaatgccgtttaataaagcgacctggtaatcccactcgcgaaattcgtcctgcactttacctaaaatcgaattacgctcggcaatcagctcaaataagccgcattgacgcagttcgtaactgtcgagcaagctaatggttacggggtctatagctatcaacaactcacgtttttcgggaagcgattgagcggccatcgccggtggtgataaggcatcgcgctgctgaacattagcgatacgcgataagtagcgatcaaaatccgcgtcgatggctagacgtggttcgcatccagtaagcagcaaaagtgcagccagtacaacgcttaaacgcataattccctcacaatagctccttttacttttcccttcttaatcgaagctgcagcttgaagtcggtaggggataatttatcactcacagaccgtctacttataacgccaagttctttaaatatacgtaatactgcgtttatggttcttctcaatcaataaaaaggccagcatagattggctggccttgaggggattttctatcgattattttgctgcaaggtgtaactgtacgtcatcactctgtttttgcagccagtacaaacgctgtcctagcatcagtgcggccgccgagagtccgatgataaatccgagccagaaacctttggcacctaagggttgctccgtcagccagttggtcatccctaggatataaccggtgggcaagccaagtacccagtaggagataaatgtacggtggaaaatcgctgtcatatctttatagccacgcagtgatcctgcggcgacaacttgtaccgcatccatacattgatagattgccgcaaacagtaagagctgcatcgctaacgctaccaccacttggttttcggtatacagcagcgcgatctgttcacgaaacaacacggtgagcaacgcggtaatacacgcagtggcaaggccagtcattaaacccacattggctgcaattgcagcgcctttggtgtcttgctcacctaacttatggccaacacgaatggagaccgcggcaccaatactcattgggaacataaacaccaaagaagagaaattgagcgccacttggtgtgccgccacgacagttgaccctaacggtgccactaaaagtgcgaccacagcaaaaagagtcacttcaaaaaagagggcggctgcaacaggaaaacctaagcgaaatagacggatcaactcttttggctgtggtttatggaaagtctcaaacacttttacatgtgccagacgcttagaggtcacgatgtaaaacagtagcagcagcaacatgatccaatacacaatcgcggttgcaacgccacaacccacaccgcctagctctggtgcgccaaatttcccgtaaacgaaaatccagttgagagggatattgagcaataacccaataaaaccaatcaccatcgcaggtttggtcagtgacataccatcggtaaaactgcgcagtgcctgaaacagtaagtaagcggggaccgcaaaaatgacggcgtgcatataaccgacggttttggtcgccattgcctcttctacatccataaaccgaatgatgaattgagtttgaaagagtaccgcaatgatcgggaccgaaaccaataacgcgaggatcaacccctgatgaacttcaaacggaatcttgtgttggcgacctgcgccattgagctgggcaacgaccggcactaaagccatcagcaaacccacgccaaacaaaatggaaggtagccaaatactggctgcgatcgataccgcggccatgtctatcgcactgacaccacccgccatgatggtatcgacaaagcccatacccgtttgcgcgactgaggcaatcagtacgggtgtcgcgagtttaattaaatttgatgcttcttttttgtaacgatgcacagagttctccaaagagggacaagcaaagaggagcctaaacagtgagtcgcgggatactcaacttatggcaatggatggcatgataatgaaatgtcgcattaagctccacgaaaaactgatttaaatcacagattgtcgggggattgatgataagacgatgaggactggagtggcggcttttggttttaagtagtttgggtatacaagcttgtaaaaagagcgccgcgatgggcgctctatacaaaatcgaatgattagaaaatttgttcatcgtctgcatcaacatacaactcaatggtatcgtgcagctcatcaactgtcatgttgagatggattgcgtgacagcaggctgggcaatcatcataaaactcctgacttccgttcgaagcatctaaagtcaaacggatcccgtgaccgcaatgcggacaggtaactgacttttccgtgaagtttctcatatctctcttccttacgtcctttgagatacagtaatactaagcagggaagtttcttaaagcgtaaaattaagtctaaagtttgaaggtcaacataaaatcaacaattaagtctggcagctatgatccaagaaaaatcaatgagtaacagttaaagcattcagtaagacaatatcttctcaatcaatttctgtgcttcatccaaataatgcccaccaaactggttatagtggtttagtacatgataaaggttgtagatatcttttcgttcttcataaccccaatcgagtggccacacgctttcatagccttggaagaactcaggttgaaaaccaccaaaccattcagcgagagcaatatcacactcgcgatctccccaataacaagcagggtcaaagcacaaggggccattaacgatgttggcgacattgccaaaccagagatcaccatgcagtagagaagggcgcggagagtggttggccaaacgagttttgaccatctcaacaaactcattgatgttggtgaggttgacccctttttcttgcattagctgtagctgccaaccgatacgctgctctgcaaaaaataatgcccactttttgtgccaagggttaggttgaactgtcgctccaatgtaattatcgatatcgaagccaaactctttttgctctccccagcgatgcaggttggccagttgcaccccaaattcgtaacttcgttcggcgtcatctaatggcttggtcgctaaataattaagcaccagataagcatgcgttttgctcgtgccgtgcagaatgtactcgggtacttgaacggtattggactcgcgcatcacacgcaagttttccacctcggcggtaaatttggtcagatactcgcgttggtttgttttcacaaaataacgatctattccatcgctaaccataaagcattcattaatgtcacccccatgcactttttctttttcaacgaggtgaaaatctttgcccaactgctcggacaattgttgaataattgctggccacataattcaagctctcggttattgatctgcatactggctataacttgaatctacagtggtgttggctaggttcgttcatcccaatcacaatgtttatctatgctcatggagatgaactcacttgccgcctacctgtaactccaagtcgtttgggtatagtttatgccaagcgctccaatatgaaagtttatgagtgcacataaatctaacttgagtaaaaattgcagaagtagaaacacctaagtgtgatttaactcataaaatcattatgttcactcccataatatcgtgcgcagtgtgcgtcatgagatggcactgcaaacaatttttcgaataatgggataaaactcatctcagtcagtcagttttagctcataattaagccgtactaagcgaaataatcgaactcttggtggaaagtgcagcaactagcatttgccatctgtgaaaatggctattcatgtcttagtattaaacaagatacaaactaactggcgaacagcagcagtaaagcggagaaagaatgtggttgtagaaaccgatggatatctggccctgattgaacatctgtcattcaatatggatgttttcactcaggaaggggatacgggaactgaaagtgttgaagatgtcatcacagatatggtggcaagcaacatcatgtctatttttgaacaaaaccctgagcttcattctagtgttcgcttccaattactgaaagaagccgattcggtggtcgaagacttaggcgaagtgttagcgggggtttggtatcgccccgcgactaatgagcagatcgcctttttggatgaatacatcgccctagtgaaaaacttgtttgactcagccgttgcgaaatacgactaaccccattcattagtttgacaacaaaggcggattctcaatccgcctaaaatgccaaaattttgaagcccagtaagggttatccattctcgaaatgatcacgcctttcgacgttgaagcgtgcataaactgcttatcccctaaatagacaccgacgtgaatattggtgcgggatgtcttaaaaaataccagatccccatattgagcatgttcatatgcgattttctgacccgtttgcgcttgagactgtgtggtgcgcggtaaatctcgttgccatgcgtcgcggtaagcaatttgtacaaaagctgaacaatcaatgccgtttttgctattcccgcctaaacgatagggtacgccgcgccactctgtgaatacactcgaaaagttcgccaatggtaggttactcgaattcggttcggatacagaagtatcaggctcggaaggcggagtggctgtacacccgacaaggaatcctagaataagcagagaaaacgtttgcttgaccgtcaacatgagtcaccttattgacaaaaaaatgaaataaaactgaaacagccactacctaccatggcgtcgactctcaaacctaagacgcatttacatggctttgacaaaaaatttatccttaacccaaacactcggtgcggtgtttctatgcataaccatactgatgattagcttatctgtcaccagtttacgtggcatagagcgggttggcgctcagtttaatcaactgtctgaacaagctttgccctttgcgcttaataatgcagcgttaacgcaaaattttctcgaacaagtgaagtacctaggttatggcactcgtagccaatctgagcaagagctcaatcaagtgctcaatgaatggcaaaagctggatgctcaagcgggagatgaaataacaagattgcagcagaacgtacaattgctctctagcgctgaagcggttcaacaagccgagcagttacagcgagagatccttcattttcaacagctagcccaatcgattctcaaacttcaacaactgcaattgagtaaaacagcacaaatcagtgagcaagcgaaacaatttcgttatggcttgagttcaatcggacctgaaatgggccgtatcgcctcgtttttagcggtggataacccagaagccatggatgcagcgaaccgatttaccgccagtgccagcgcaatggaaagtgcttttttattgctgtttatcgaagaagagatgtcagcagcgcaaaaataccgccaagagttaaaaaatcgggtagcgggattggaactggcgtttgatgacttcaaagagtggtacccagaaattaaagattacgcgagcttaactgccccctatgaaatggtgttagcaggctttcaagcgcaagccgtgatagagcagatcattaataaactggaagacgcgcaacaacaaaataaggattttgcaagcgctgcagaggttgcgcagcaacttgtcacgcagctcaatcagtggtcaacattggctcaacaacacattgtgcagggtaagcaagaggtaacatcaaccatttctgccgtcaccctcacacagcaaatcagcggcactctcttggtgctggcgattttggcggtgtggtttggcttgcgccgttggatagggcgagcgctgaacaacatcactcgtcatctcgcgcagttaacacaacataagcttaaccacagattagatttagtcgggccgcaagattttcaaaatgtcgcagcgcaactcaatcaagtgatcgtatcaacgcatgagtcgctcgcattagtcacgcgcaactgcgaaacgctctaccaaacggctgagctgagccatggttccgcagaacaatcaaaccaaagcttagcggcgcaaaatcaagccttgttgaccatggctgcaaccattaatcaactggatgcatcaattcgcgaaatcgccggagtgagtcacgattcgtacacggattctgtggaagcggcggaacattccgcgcaaggtgtgaaggtgatagagcagaatcagcagcgtttacaagcattagaaaccaccttagcggttaatgatgcggcgatgtctgaactcaatcagcgcgtaaccagtattcgtgaaatggtggatatgatcagtggcattgccgatagcaccaatttgttagcgctgaatgcggcgattgaagccgcacgagccggagagcaagggcgcggttttgccgtagtggctgacgaagttcgtaaattggccagtgataccagtaaacagaccaccaatattcgtgacatgatgaatgagttggtgactgcggccagtaaatcacgccaagcggtggatgaatcgcgtaaagagatggtcaccgccctacaatcgagtgaagaagtaaaaagtacctttatgcagattgagcgtgcagtggcacatattcgcactcgagtcgagcagatcactcaagcgaccgaagaacaaaagcgagccacggcggatgtaaacaaagcggtagcgcaaatttccgaacaagggcaagaaaccaaacgtcagttggatgccatgttggaaagcgcggaacaagtcgcagagattgctggtcatcaacaagcgatgttgcataagtatgagttgaactgatttaacgttcgcgaaacggttgagtcagcattttatccagccactgttctcgtgcttgacgaaacagtggcaagccaatcttcattcgctcatggcccatttctggctgcgcaatataggtgtgaaacatcttgtcccatatcgaaagaaaaaagccgaagttggagtgggtctcgtgaactaaaacggagtggtggactcggtgcatgtccggtgttacaaccagtaaacgcagccactggtcgattttatagggcagcttagcattgctgtgattaaacatcgcgctggcattgagcaaaatttcaaacaccacgacggccaacggagatgcacccaataacgtcactgcgccgatttttatccacgcagaaatcattatttcgagcggatgaaagcgactgccagtggtgacatcaatatcttgatctgcatggtgcatgcggtgtagccgccacaacaaaggaatacggtgaaacaacaggtgctgccaataaatcaccgcatccagtaataccaccgcaacgaagagcgcgatgaaaggtgggatctccaaccaatacagcaagccaaactgttggctttgcgcccattgcgcggcactgaaggctaaaattggcatcagcgcggtgatcaaaagactattaaagccaaccaatccgaggttattcagccagcgaacccgcttgctttgcgacaaggttttgcgtggacgattcgattcccacaaggcacaaatcactaatacagagaaaaaaatcgctaagcggatcagctcaatttgttcactcattgggttctccttgatttgggccacgtcgagaatctttactggcgcaaaagccctgtggtcagtaaaatcgcagccatttttccgccagtagtccgagccatgagaattcacgcgtttcatcacttatatcaatatcgcctagaacgttcaaccaagccatttttagcgcggggtggcaagattaaacgctgcttgtactgtctggttgagttgacgcactgcttgtgtgcccatcagcctgatattgaaagccaagtggcggtactgctgatcgtctctgaaaacgaagtatttaaacccagcaacactgggcgcttaattgcagacacggtgaaagagacctatgtatatcaatggagtcgtacggagccaaacccagagatgctcgcgttactcagtaaccctgcctattatccggtgctgatttttcccgcggaaacggaagaggacaaaactcgcgtgttaagcccaatccccactgagtttgcaggcaaaaaaccattattggtattgattgatggcagttggcgtgaagcgaaacgcatctttcgcaaatctccgtatcttgcatcattgcctttggtatcggtggagccggaacgcttatcgcaatacatcatgcgtaaatcggaaaacgaacagcacttggcaacggcagaagtggctagcttggtgttggacatgttcggtgatcgacactccgcaagtacgttatcgctgtggttcgaagcatttaaagaaacttacctgacctgcaaatcgcgcaataagccgagtattactaaacccgcattgcaacgatggatagcacatcaacaaaacgcgaactgcctctaaacttgcgtgtgaccttggtcgcttattgtgcaatcagtgccattggccagataaataagtgctttgtcacggactgttgagggtagcttgtggataatacgcctcacttttgtgtttttattttttcccaaggctgggataggaaattgaggagagaaggccatgtattacggctttgatgtgggcggaaccaaaattgaatttggtgcgttcaatgaacagttagaacgcgttgccacggaacgcgtcgcgacaccaacggatgactatgccaaattggtggagactattgccgggttagtccataaatacgatgcgcaatttggcgtcgaaggtacggttggtctgggtattccgggcatggaagatgccgataatggctgcgtattgaccgttaacgtgcctgcagccaaaggcaaaccgctgcgtgccgatttggaaaccaaactcggccgcgcagtgaaagtggaaaatgatgcgaactgttttgcgctctctgaagcttgggatgatgagctaaaagaagcggcttccgtgatgggcttgattctaggtaccggttttggtggcggactggtctacgaaggtaaagtgttctcaggtcgtaaccacgtagcgggtgaaattggccacatgcgcctaccgattgatgcttggttccatcttggtgaaaaagccccattactgggctgtggctgcggcaataaaggttgtatggacaactatctctctggccgtggctttgagctgttatacgagcactattacggcgaaaagaaaaaagcgattgatatcatcaccgcacagaaagagggtgaatccaaagccgttgagcacgttgagcgctttatggaattgctggcgatctgtttcgccaatatttttactgccaacgatccacacgtggtggtgttaggcggcggattatcaaactacgatctgatttatgaagaaatgccaaagcgtgtgcctaagcatctgctctctgttgcgaaatgcccgaaaatcgttaaagccaaacatggcgactccggcggcgtgcgcggagcggctttcctcaacattaaataagttgaagatcaacagaataaattaagggcttgcactgcaagcccttttccccttcctacttgaagttgcagcggtgttggctgcgttcattcaccccaatcacatagtttgtctatgctcatggggattcactcgcttgccgcctacctgcaactccaagtcgtttgggtatcggtattttaaaattacagctaaagcatattggcttagcgagtcgcttttggttttttgcctacaccaaaattctctttaggttgtagcgtgatgataccgaaaccgagctttttgaagtggttatcacggaagttacgcaccgatttagtatctgaaatcgcttccagttgcatctccatcttcagaaattcggtcaggtcaatgccttccgcttcggctaccgcttcatgaatgttgtgatgcttttcgtatgagaaagtcagcgttttctcttggtttttgtaggtgtaaataattgtacgagccatgttttctctcgacgctgagcagcgtttatgtcgttaagattttatgactgcgatgatagcacaagccaaaagcggtattgcagcaatattctcgactttctttgcgatgaacagagatagggtaattgtgacttttggtgagttaaaggttgagtttatggttatttttccactcaagctctatgctttctctagttatgtgtgaggtctagtctatgaactatttcattcgtcagtcttggttatttttctttacagtcacaagttcttttcatgtttcagctacaacgactcttcgattagcctactcagatattgaatcttacccgtttcagatgggcaatggtgagtctgttgccaatcctcctggtctagcgttagatgtcctcaatgatgtcgcaactaagttggaactgaaaattgaatatgttcgtcttcctggtaaacgggtattggattacattgatacaggcaaagtagatggcggttttatcttttcttacaacacactacgagctcagtatgctcgttatccaatgcaagatgatagtccggatagccaaaacggattgccacgatcggttattacttttacacgcttcaagatcagaaattggattgggatggagagaaaattttgaataccgaacaacaagtcggtgctcacttaggattttcgattgtgaatgagttgaagaaaaaacaattgaatgttcaagaagtcaccaccacagaacaacttttccaaatgttacaactgggtcgcttacctgttgtcgccgttcaagatactaccgctcagcagtttctcagtagtaaaaaaatcaaaaacatcacgaaagtagaacctgcaatcaccaccaaagattactacttagtgtttagtcaccaattttatgatgcgaatgcagagattgcagaacagatatggcgagaaattggagcactcagagaggaggctcactcaaagcatggaggtaaatatcttgagtgatgatggatgttcttgattgccgcttttggtaaagagtccctatattgacgtcatactatgaagagaagcaagtatagggagtgaacacactagattctgccttgaagtgggatgattgtcacgctttcaccgacttttaccgtatcaatcgccggagcaatttcaatcaagcagttcgcttcactcattgagcgcaaaatccccgaaccttgtttgcccgtggtacgtactgtcagttgtccttgcgtattaaaagcgtaaaccccacggctgaactcagttctgccttggcgagagcgcagatcttccaacgcaatcgcattgactttcagtggttgccaaccttgttcaccttgcattttacgcagagcaggttccacaaagttgatgaaagaaaccattaccgcgacagggttgcccggtagaccgaagaaaggttttccagcaatctggccaaacgccagtgggcgtcccggacgcatattgatccgccaaaaatcaatttgtcccagcttctctagcgcggatttgatgaaatccgcatcgcccacagaaacaccaccggaagtgatcaccacatcagcctgttttgctgcttgctcaagcacttgcatcatttttgcttcgtcatcttcgatgataccgagatcgatcacttggcagccgagctgtttgagtaatcctgtcagagtaaaacggttggaatcaaaaatagagtttggctcaatgtcaccgccgggcgcttgtacttcatcgcctgtcgaaaaaatcgcgactttaagcgagcgaaatgcgtccgcgtgcgcaaaacccagtgacgccaacatgcccatttctggagaaagcacacgctgacctatgctaaagaccgcttggccttgcgccaaatcttcacctgcttggcgtacgttttgtcctgctttgattttggcacccgcaaaactgaccagttcgccgttttgcgtggcttgctcacgcattactaccgtatcagcaccgagtggcattggtgcgccagtcataatcttcaccgcttcgccgcgttcaaccgttttcggataatgactaccggcgagcacttccgccactacacggtagctatcgcgttcaagatcatcactgcgcagcgcatagccatccatcgctgagttgcgataggcgggcacattgttcggagagaaaacttcacgcgccagtacgcgttgatagcactcttgaatcgctaccgattctgtctctgccaaaggtgagatgagcgagaggatcttctcgcggccttgttctacagaaaggaaagcaggggataaagtgtcgcagcatgccgctgcattgtttttggaatctgacactgtgtgtggttgaatctgctgcgcgcgccacttattgacataatccaaaacgaaatcagcgatcgcatcgagatcattaatgtgcatttgcggcagatccgttgcgaccgtctcatcggcagcaatcgcaatgatgtttttatcatgagggtaaagccaaggcttaccgacttccgcgcggtgcagttcaatttttggaaaagcgatatttttacagccttcaaccaaaatcacatcgagcttttcagcatcaaatcgagtcaacagataatcaaactccgcttcggcatcgggggtttcggtcattagcgcatgacggttacgcgacgcaatcagcatttgagacgctcccgctttacgtaagcgataactgtctttgcctggcttatcgacatcaaaatcgtggtgcgcgtgtttcagcagaccaatgcgcaaaccagttgctgtcagtttaggcagcagggcttctagcagcgtcgtttttccggtgccagaataggcagcgaaaccgagtagtggcaggttagggcgttgaggattctggtgtgcagaagcaatcatggatgtaacgctccaaattgcgccaactcttgtggcgtattcaaattaaaaaagcagcttggtgcatcgctaaaatcgacgtaagaagtatggcattcatcgtaaagcaagatgattttgcgatcgccacgggctaaaaaggcgctgagtttgggtaacacgcgtttatgaaatagggtaaacacaggttgctgatgttcaccatcatgagccactaaaatatcgctcttgggtttgacagcctgacagaaacgggcgactaaatcatcgcaaattaacgggctatcacaagggacaaagccgacccaatcggttggtgcatggcttaaaccggcatgaatgccgcctaacggtcccggataatctggaaactcatcactgatcaccggcgcaaattgttggtattggctttggttgcgattggcgttgatgagcaaagtcggcgtttgtggggccaacttatcgatcacatgttgaaccaggggctgaccattcaactggatcaggcctttgtcttgtcctcccatgcggctggcttgtccgccagcaagaatcacccagctagtgtcggaaggttgaagcgtgggaagtgtttgtgtggttatcattgttttctttcacaatctgcagcaaaggcgactcaatcagttgacgctctttaatccaccactgctttttacacagcgccgtgagggcgttggtttggtggctagtgatgacaagactggagccgcgctctaataaatctcgcgccattataaccaatctctcgatagattcttgatccaatgacgcactcggctcatccatcaacaaaatagagggcttgaggatccacgctcgcgccatcgctacgcgctgtttttctccgccggaaagcacagaaatatgctcatcggccagcgtttctagcccgaccatacgcaaggcagtgatcacttgcgcgcgcttttcatgcgcagacaagccactgaaacgaatgccgtacaccacattttgataaaccgtgtcatcaaacaggtaggggctttgatgaagatagacaacttctgaggtcgcggaagtcaaaaacaagcgctgccaccaaggtttacggccaagcactctaccattgctcggctctaacaagcccgcgagaattttcaataaggtggttttacccacaccattgtcgcccttaaggtaaatggcatcattagggccgatggcgatctcgggaatatgaaataacacgcgatctttaaaacgcatggaaagctgctgtgcggtaagtttgatcgtcatgattggccttatgtccttaaatagcctttgccccgtagggaagagagcagaaagttgagccctagcgctaaggcaagcagcaccatacccagcgccaccccctgcgcaaaagcgcctttattgctttccaatgaaatggccgttgggatattgcgggtcaagcccatgatattgccaccgaccatcattgagcagccaacttcggtcacgatacgggaaaaacccgcaatggttgcggccattaaaggaaagcgcgcttcccagactaaggttgcaaagagcctaggtacggaagctcccagcgtcattgaagtttctagcgagcggcgatcagtcgattgcaacgcaccatgcatcatggcaaccagaatcggaaaacagatcagtgcttgacctaaaatcatcgcttgctgggtaaacagcatctgccaatcacccagcgggcctgcgcgtgagagcaacatatacagcagcagacctatcacgacagttggaaccgcttgcagggtattgatcagcgaaagcagagtccatttaccgcgaaaattggtgtacgccagcacaaaagagagcaccacagaggggatgagcaccagagcaatggccgttagcgaaacactaaaggagaccgcaacgatctcccatagcttaggatctagactcaccaacagatgcaaggcatctagggttgtttgccaaagactcatcgaggattactgcttgtccgcattggccacaaagagttgttggccattgactttaaactcgttaatcaactgctggcctttagggttcaccagccaatcactaaacactttagcggcatgatattgggtggttgggtaacgctcagggttgacaatgatcacttggtaagggttaaacagttgctcatcaccttcaaacagaatcttgagagccaacttattgttgtaagccagccaagtccctcggtcggtcagggtataagcctgcatttctgacgccatattcagtgttggacccatgccttgaccaatagaacggtagccaccgaaattcggttcaatcttgttttgtgcccaaatgccgagctctttcttgtgtgtgccggaatcatcaccacgtgagataaatacagcgccgcttttagcaatattttcaaatactttcgcgatgttcttttcatcggcgattttagccggatcactttctgggccaaccaccacaaagtcgttgtacatcagtttacgtggtagaacaccgaaacctgcctcaacaaagctggcttcggctttcggtgcatgggtcatcaccaaatccacatcgccattttcgcccattttcagcgctttacctgtgccagtggcgatcacatccactttataacccgtatcttgctcaaattttggcaggaggtaatcaagcaagccagaatcgtaagtactggtggtggtcgcaagacgaatacgagcgtcatcggcactagaagccgagtaactgaccaaaattaacgaagcggctgcgagggtaaaggttgtttttttcattgtgaattccatgacggtacgttggaggtaaagtcagcgatctagatcagctaatacactgataacactgaatgaaatcaattgctgatgagtttatacgaaacagaggtatagcaaatgggatgccaacgtcattcttactcattgagggctattttccctgcaaaaagtcggtgatttgtggcaaatctggcctaaagatagtgacactttaaaccgtgtgggacaaaatgtcgcaaattacgcctagccaatgtaaggttaattgagtcgttctgtctcaataagttatggaatccctctatgtcaccagttttggatctcaatcaaacccatttatatcaagccttctctgttttacttgttgatgacgaagtcggtatgcaactggtactgaaaaaagcgctgagtaaatggttttcgcgcgtcgatttagccagcagcattgaagaggccgaggtgctgcgtggtgagcatcactacgacttgctgattttagacatcaacctaccgggacgctcagggattgaatgggaagaagcgtttaccgatccggatcaccgcgcggatgtgatttttatgaccggattcgcggatcttgagaccgccatcagcgctctcaaactgggggcaagcgattttatcctcaagccatttaacctcgaacaaatgctgcaagcggtgcaacgctgtatgaataagcgcctcaatgagcgtttgcagtacgccttgcagcgtgattttcaacgccactgcacaacacaaatcatcggcagttcagtgcaaaccgaattactcaagcagcgcattgttcaatttgctccgtcgcgcgcttcggtgctgattgaaggggaatcggggacgggcaaagagttggtcgcacgcggcatccatgaagcgagtggtcgccaaggtccttttgtgccaatcaactgcggcgcgattgcgccagaactgctggaaagtgaactgtttgggcacacctctggggcatttaccggcgcgaagaagagtcgtgaagggctgtttcgcgtggctaacggcggcactctgtttttggatgaaatcggcgaaatgccactgaccatgcaagcctcgctattacgggttttagaacaacgcgcggtgcgcccagtgggttcggaaaaagaggtgaatgtggacgtgcgagtggtggccgccaccaaccgtaatctgcaacaagaagtcgaaaatggccgtttccgcggcgatctttactaccggcttaatgtgttgaaaatcgaagtgagcccactgcgtgagcgcaagcaagatctgcatgaactgttgccgtttttcaccaaaatgctctgtgcggaactggggatgccaatgcctaaatgggcgtatgaagatatctcttcgatgcaagactatgattggccgggcaatattcgcgagttgaaaaacttaattgagcgctgcttgttattgggcaaaccgcctgcgcattattggcgagagctcaatggtctgcctatttatgcagaacccgaggtgacaatgtcacagagtaataattctgaaatttcacttggtgacaatgtcacgcagcccagcttgggatatcccaacgattggcctctgagtgcggtggaaaaagcacatattcagcaaattgtggcgctgcatgagggcaataaatcggccgccgcccgcgatttaggcgtggcacgtaaaacgttggagcgtaaatacaaagagtgggaaagcgaggatctcagccatgaaagctaaatgggcttggtggcaaaaatggcgacaccgttttcaaaccaccgtgcgctatcggctgtggattctgacctcagcgccaatttttctcacactgctggcgctgattgcgatcaccatttactggtcactgcattacacctggaacagtgctttaattgatgtgtctgagcggttaggcgtggcgcaaaacagtgtaactctactgcaacagaaacaagccaatcacgttcgcgcgtttgcagaatcgtacgattttcgcaagcgtctgcaagagccggaaaccctcagtactttgccacgttgggtgcaaaatcaaaaaaatcgctatggcttagatttcttaagttttgagcgtgtggatagcttagagcagaagtttcgctatctcgatctcaccaagcgtgaatccttctttgatgtacttagtgccgatgagctagaaaagctcgatccggatttagctaagcaagcgcaaatcccgattcttaattctcaacagatcgaaactcggggattagtcagtcgtaccgtgattccagtgcgcaatgacttcggtgagatcataggttttttggatggtggtttactgctcaataacagcacaaccttagtcgatcaaattcgagatctcatctacccaagtcatcaagatcagcttcgcccaacgggcactttaaccctgtttttggatgacttacgcgtcagcaccaacgtgcctttagacagtaatatccatgcaggtcgcgcgataggcacacgggtgtcatccgaagtgtttaatcaagtgctcaaaggtggtcagcagtgggttaatctggcgtatgtgtatgatgcttggtacatcaccgcgtatgagccgattcgcgatcaataccacaacgaaattggcatgctgtacaccggctacttaatgtggccgtttttaaaagcttacgtgaccaatattttagaagtcgggatcatcacgcttttcctgctggtgatttcaggcctgtttgtgtaccgtggctcgcgcgatctgtttcgtcctatcgagcgcattcaccgtgtagtgaaaatggtgcaacttggtaaaaaccagcgtattggtcaaattgggcttgatgacaaacatgaactcgctcagcttgcgaagcaattcgacaacatgctggatcagttgcagcaacggaatgaagaaatcgtgcaagccgcgcatgagttagaagcaaaagtgcaatcgcgcaccgccagtttgcaagagaaaaccgcgcagcttgagcaccacattgccttgcttaaccaaacgcgcaataagttagtggtgcatgaaaaactggcggcacttggtgagctaaccgcggggattgcccatgaaatcaataaccctaccgccgtgattctcggtaataccgagttaattcgttttgagcttggtgctgatgcgagcagagtcgaagaagaaattgatgccatcttgctgcaaatcgagcggatccgaaacatcacgcgcagcttgttgcaatacagtcgccaaggcggagtgcaggacgaaatcacgtggcaacacgtcaatccgatcattgatgagagtattaccttagtcaaaactggttcgaaaaagcgcgatattgaatttgtgctggaactgaaagcgcacaattcggtggaggtgaatcgccatcaactgctgcaaattctggttaacctacagatgaacgcgattcatgccatgaacggcaaaggccgcatcacgatacgtagcgaagattgggttgaagaggggcaaaaccgcggagcggtgatccacattgaagatcaaggttgtggcattaagccagaaaacctcaaacgtattttcgatccgttttataccaccaaacgtgaggggacagggcttgggctttcggtttcacaaagtttgcttagccagtctggcggagaaattaaagtgcagtctgaattgggcgtgggtagcactttcagtatcttcctgccttccaaaaatgaagcgaaacttcgcgagaccttgctgcttcaataatccccctacgaaaagctcgttattttgttggtcatttcacttgagatgactgactttcatgcgcgttatgtaaatcagggcttgtagtctgggcgctgaacaagtaacgttgcgcagatttttctatttgtgatccctgtcagcttaatttagccactcgaagtgcgccgttttaagtgggcgggaatgttaacgcactaaggtacaggctttgatttctacagcgaatatcactcaacaatttggcgctaagccactgtttgaaaacatttcagttaagtttggcgaaggtaatcgctacggtctaatcggggcaaatggctgtggtaaatccaccttcatgaaaatcctcagtggtgagctcgaaccaagtggcggtaatgtgagctacgatccaaacgagcgcgttgccaagctgaatcaggatcagtttgcgtacgaagagttcacggtaatcgacaccgttatcatgggtcacaaagagttgtggaaggtaaaacaagagcgtgaccgtatttatgcgctgcccgaaatgaccgaagaagatggtatgcgtgttgccgatctcgaagtggaattcgccgagatggatggctacatggcagaatccaaagcgggtgaactacttctcgcggtgggtattcctcttgagcaacattacggcctgatgagcagtgtggctccgggttggaaactgcgtgtgctgctggcgcaaatcctgtttgcagatccagatatcatgctgcttgacgaaccgaccaacaacttggacatcgacaccattcgctggttggaagatacgctgaatgcgcgtaactgcaccatgatcatcatctcgcatgaccgccacttcttaaactcagtctgtacccacatggctgacttggattacggtgagctgcgtatttacccaggcaactacgacgaatacatgactgcggccactcaagcgcgtgagcgtctgttatctgataacgcgaagaagaaagcgcaaattgctgaactgcaaaccttcgtagcgcgcttctcggcgaacgcatcgaaagcaaaacaagcgacttctcgtgcaagacagattgataagatcaaactggatgaagtgaaggcatcaagccgtcagaacccattcattcgtttcgagcaatcgaaagagctattccgtaacgcccttattgttgaaaacctcagccaaggttttgatcatgacctgttcagcaacttcaacgcgatttttgaagtgggtgagcgtgttgccatcatcggtgagaacggtgtgggtaaaaccacattgctgaataccctagctggcgtacttgagccacgtagcggtatgtacaagtggtctgaaaactcgaatattggttactatgcgcaagaccacgctcacgagttcgcagaagatctgaacctgatggagtggatgggtcagtggcgtcaagaaggcgatgatgagcaagtggttcgcagcttcttgggccgtatgctgtttggccaagatgacatcaagaaatccgtgaaggtactgtcgggtggtgagcaaggtcgtatgttgcttggcaaactcatgatgcacaagccaaacatgctgctgctcgatgagccaaccaaccacatggatatggaatcgatcgagtctttgaacaacgccttagagcaatataaaggcacgctgttcttcgtatcgcatgaccgcgtattcgtagactctttggcgactcgcatcatcgaaattcgtgatggcaaaatcactgacttcaaaggcacttacgctgagttcctgaaatcacgtggcgttgaaggctaagtttcctaagccaatattttgcatgctaaataatactaagagcctctatgtgaggctcttttgctatccgaaacacgttaaaaacctctatggtgcaaagacgttgctatgcctcttcactgtggcctttcacatcaaacaccattttgtctgcgccactgtacacatgaaagcgacgaccggaagcgcgagcaatcgtggtaatgccaaaacgttgcgcaagctcaagccccatttgagtcacacccgagcgcgatagcagcacaggaatccccatttgcgccactttaatcaccatctcggaggttaaacgacctgtggtgtaaaaaattttgtcatccccacgcatgccattgagccacatttcaccggccaaagtatccactgcattgtggcgaccgacatcttccacaaaagagagcacccgatcctcttggcaaattgcgcagccatgcaccgcgccggcttttttgtaggtatcgttgtagtgagtcaatgcttccagagcagcgtagatttgtgactgtttaattggctgttgcggcacttgataatgttcaagctgcttcatcacgttgccatacatggtgccttggccacagccggaggtgacggtttttttcttcagcgcaggctctaaatggtcaatgttttcacgcgtaaccaccgcggccgaatgagtttcccaatcgatgatgatggaatcgagcgcttccggatcggaaataaaactttggttcttcagataacccagcactaaagcttctggccgcgaaccgagcgtcatcaaggtcactatctctttccagttgagcagaacagtgagagggcgttcacaggcgatcgatttcaccagtttttcgccgtattcgtcatacacttcaacctcaatggtttgcagaggattttcgctggttttgatgatggaaggtttagccacgctggattcctgtgtattgctcgctttattcaccgccgatctgtcagtgcaaatcttgcggtagagcgaataagaaaaagtgccgtcaatgtagcaaaaagggtgccgaatcaaaaacaaactgcacaaaagtgatgatgttgctctacttaaagcaaggtactggtacccatggcgcaattattgctttaatttcaactctgattgttaatttagtatgagttatgactgaacaaacttctcctgaatccttaacggatggtgctcatagtaaaaccgacagcgcttggccgctcgcttgcaaccttgagccgcgtttggtctcacgtggccgttggcaaaccacgcagtggatgttgcacggtttcagtttaacgccagaggcgcagagtcaatatgtcgcaaccttgcacttgtatcgtgacgagcgtactgactatcgctttaacctcagttcacaagcgccaaagctgttcttggttgccgaagatccgattgaagatcagccgcttaaagtcgtgcaattgaccgcatcgcaagccgtcgccagccgctatatggacagcgattatctggtgctgtcggccgatatgccgctacccgttcaggcgttgatggaagcctatattggtcgtcacggtgagctactggaaattcgccgcaagaaacgtgaaggcgcggggaggtcttgtggcaactgaaaacaggtttttctctcgttggtcacaacgtaaattaaccgcagaatcagaccaactgcttgatacccaaaagagttttgactctcagcctgtgcaagaggagccgatagaaagtgagtccgctgtagaaacggaaagtgggttggagagccactcgctcgaacaacctcattcagcagagaatgaagaacccagcgtagcgagtttgttggtatccgatgcgtcgcaagaactgaagaaagcggcattgcgtaagctgtttttaagcggcgagtttagcgaagtgtgtatgctggatgattacaacgcggattacagcaacacagcaaccctcaccacgcaagtcgcacaaaccttacgccaatggtgtaatgagctagaaacgacgccagaggttaagtctgaacaggctataccggaaaaagccatgtctgaccaaactatgactgatttaagcatgcctgatgaaacgacagcttctgcgcccgaattcgctgaggattctgcgcggctttctgatcacaatacgctttcttcttgcgatactgcggcatctgacacactgaacagtgagacaaaatataccgtatagagattagggacattttgacttactcctcaataggtagagtgagacataatgtctcactcttattgtggcttttcatttctcatcccagttatcgataaattctctgatttttcaataaaataaatttggaacgctatttgctttagcttatgtaaaacgagccaacacgctcgtgattcttataagcggaagcaagcaatgttaaacaacctactacaacaagcgacgtctccaaacggtcgggcgagacagtatgcgattgagcatacggttgagttgaccaatcttattcctcctaccgtaagttacgaaagtggcggccataccttaattattggacccactatgctcattgagcgtattaccgagccactgagcagtatggcttcaatcacgctcctttctgtggatggtgagcctggcacacaaagcaatttgtactatgccgatacggtagaaatcagcggtttcctcggcgccttctcggtgaacgtagaaaaccacggtaaacgagtcaatttggcgcaagccgcgataggtggaaacagctttgatatcgtattggatatgtcactcaacggtttaatgagtgaagaagtacctgtacccggttattttccagtaggacgcggttatccaaagctggcggatgcgctggaagagatcccaactctgatgggcactttcgataaacctaagtattttcgcttggatcccgatttgtgcgcgcacagttcacgcggtgtgaaaggctgtgaacgctgtgtggatgcatgtcctgctggcgcactgtccagtgaaggttcagagcaaacagggcatcggattcaaattaacccttacctgtgtcagggcgtcggaacctgtgcgaccgcttgcccgacggaagcgattcactacgcgctgcctaatcctaccgatacgcaaaaatttattgagcgattactggcgaattaccaccaagctggcggtgaaaaaccgatcgtgctgatctgcagttctcgacatgaaagttacaacgtcatggcacttaaggtattaccagataacgtgattcctgtggtggtagaagagctgccttctgtcggtatcgacagctggtttgctgctttagttaacggtgcaactcaagtgttgtttgccgcgagccgtcatatgccgcccactatccagcgtattctcaaccaagaaatgagcatggcgcagagcttgctgactcacttgggtttgcccaaagagacgattgatattctttatctcgaatcgctacgcgaggggatgccggtactgtgtgaacagccgcttgggcttaagttgggtgacttaatcggtaataagcgcgaacgtctgtttaccgcgctggatgcgttagcagaaacactcaatgcacaacctagcgttcaaccactcagcatcagcgcgccttacggcaccattgaatgccaaacaagcgattgtactttgtgcatgagctgtgttgcggtttgcccaacacgtgcactgcatctggctggagatagcccagcactacgctttattgaacaagactgcgtgcagtgtggcttgtgtgtcaaagcttgccctgaacaagtgcttagcgctacaccacaactcaactggaacaaagcggcacgccaaggtgtggtgacgttgcatcaagaagaacccgctaagtgcctgcgctgccataaacctttcgcaccacagtccatgattaccatgttgcaaaccaagttacgcggtcactcacatttcgccacgccggaagcgctcaatcgtattgcgatgtgcgaagactgccgggtagtagacatgtttgaagccatggctcatgaccctgagcagcagctcaagtattaaggagaaagccatgcaagagcaatctatgcgttcacagtcaacacattcacagtcaatgcgttcagacatttacctgctgctcgccacactgctgcgtgatgtgccttcagcagaactgtgtgcctttctggccgaattggactttgaggccaatggtaccgaaatggcgaaagcgtggcaggcgatgtccgccgccgcacaaaacgctcaagctgactctttggctgacgagtatcaagagctgtttattggtatcggtcgtggtgaagttgtaccttttgcctcatggcatttgactggttcattgatggaaaagccgctggccgatattcgtgatgatttgagccgcttggggctggagcgtgatgagcaagtgcgtgagccagaagatcacatctcagcattgtgcgaaaccatggcttatttatgtgaggaaagtggtgacgagaatgctgccgaagaaacgcaacaagcgttcttcaaccgtcatatcgccccgtggtttggcaaactggtgagccaaatccgtcaggctccacatgcccaattttatttagccgtcgctcagcttctggacgcttttttgagtttagaacaagtggcgatgacacaagcaccaagcagtcgcaagaatcgttatcggatcgaggtgaaaaacctgactgataaagctgagcagtgaacaaaccggaattagaaaacagacgtcttaagacgcacagctaagttgctaaaacttaagcaataaggaagcaatcgatgaaaaaagagaaccaagtaaaccaaagcagacgcgatctgcttaaagggttaggcacagcggctgtcgctggcgctgtcgtagcgggggtaagcactcaaacggtcgcaagtgaatcaagcaccgagagcaaagagccgctgaaaaaaggctatcacgaaactcaacacattcgtgattactacaacacgctataggagccaacccgatgagactcatcaaacgttcagacagcgtgaccaaagagcaaaatcagctcggtattagccgtcgtgcatttatgaaaaacacttcactggcagcgggcggagcggcggtaggtgcctctttgtttacgccgggcatgatccgtaaagctcaggccagcgaagtggatcgcagcgcaaaaacggaagtgaagcgtactatctgttcacactgctcagtcggttgcggtatctacgctgaagtacaaaacggggtatggactggccaagagccggcttttgatcacccatttaacgcgggcggccactgtgcgaaaggcgcagcattgcgtgaacacggccacggtgaacgtcgcctgaaatacccaatgaagttagaaggcggcaagtggaagaagatctcttgggaacaagccatcaatgaaattggtgacaaagcgctgaagatccgtgaagagtcaggcccagattcggtttacttcctcggcagtgctaagcacagcaacgagcaggcctatctgttccgcaaaatggcttccctgtggggcaccaacaacgttgaccaccaagcgcgtatttgccactccaccacggttgcgggtgtagcaaacacttggggttatggtgcaatgaccaactcattcaatgacatgcacaactgtaagtcgatgctgttcattggatctaacccagcagaagcacacccagtcgcgatgcagcacattttgatcgcgaaagagaaaaacagctgcaaaatcgtggttgccgatcctcgtcgtacccgtactgcagcaaaagcggattactttgtttccctgcgtccgggtagtgacgtagcctttatttggggcgtgctgtggcacgtgttcaaaaataactgggaagacaaagagtacatccgtcaacgtgtcttcggtatggatgaaatccgtgctgaagtggccaaatggacaccagccgaagttgagcgcgtcactggcgtaagcgaagaagaagtctacaacaccgcgaaaaccctcgcggaaaaccgtccgggttgtgtggtttggtgtatgggcggtactcaacacaccacaggtaacaacaatactcgtgcgtactgcatccttgagttggcgctgggcaacatcggtaaatcaggcggcggtgccaacattttccgtggtcacgataacgtgcaaggcgcaaccgacttaggtgtgctttccgatacattgccgggttactacggtttgaccgaaggttcatggaaacactgggcaagcgtatggggcgtggatttcgagtggatcaaaaaccgctttgaccaaggcacttataacggcgcattgccaatggaaactccggggatccctgtctctcgttggatcgatggtgtacttgaaaacaaagacaaccttcagcaacgtgaaaacatccgcgccatgttctattggggtcatgcggtgaactcgcaaacccgcggcgtggaaatgaaaaaggcgatgcaaaagctggatatgatggtgattgttgacccatacccaacggttgcggcggtaatgaacgatcgcaccgatggagtgtatctgcttccagcgaccactcagtttgaaacatacggcagtgtgacggcgtctaaccgttctattcagtggcgtgatcaggtgattgagccgctgtttgaatccaaacctgatcacgaaatcatgtatctgctcagtcaaaaactggggattgcagatcagttgtgtaaacacattcgggttgagaacaatcagccactgattgaagacatcacccgtgaatttaaccgcggtatgtggacgattggttacaccggacaaagcccagagcgcttgaaaacacaccaacagaactggcacaccttccacaaaactacgttggcggccgaaggtggccctgcgcatggcgatacttacggtatgccttggccatgttggggaacgccagagatgaaacaccccggcacacacattctttacgatacctcgaaaaccgtagccgaaggtggcggtaacttccgtacccgttttggtgtggagtttgaaggtaagagtttgctggctgaagatagctactcgaaagggtgtgagctgcaagacggctatccagaatttagcgataagctgctgaaacaactcggatggtgggatgatttaactgcggaagagaaagcggctgcagaaggtaaaaactggaaaactgacctttctggcggcattcagcgtgtcgcgatcaaacacggctgtattccatttggtaacgcgaaagcgcgggcgattgtgtggacattcccagaccgcgtgccgctgcaccgtgaaccgctgtatacaccacgtcgtgatctactcgctgattacccgacgtgggacgatcaagcgtttattttccgtgtgccaaccctgtacaaatcgattcaagcgcaagataaatcagtggaatacccgatcattctcacttcaggtcgcttggtcgagtatgaaggcggtggtgaagaaacccgctctaacccttggctagccgaactacaacaagagatgtttgttgaagtgaacccgaaagatgccaacgatttaggctttatggatggtgatatggtttgggttgaaggcgcagagaaagggcgcatcaaagtcaaagccatggtgactcgtcgggtgaaaccgggcatggcgttcttaccattccactttggtggcaagttccaaggggaagatctgcgtccaaaatacccagaagggacacagccttatgtggttggggaagcggcaaacaccgccacaacctacggctacgatcctgtcaccttgatgcaagaaaccaaagtcaccctctgtaacattcgtaaagcgtaaggagcttacccatggcaagaatgaaattcctgtgtgacaccaaacgctgtatcgaatgtaacggctgtgtcacggcctgtaaaaatgaaaacgatgatgcgctggaatggggcatccagcgtcgccgcgtagtcacgctcaacgatggtgagccgggtgaaaactcgatttccgtggcttgcatgcactgtaccgatgcgccttgtatggcggtgtgtccagcagactgctttgtccataccgaagatggcattgtgctgcacaacaaagatctttgtatcggttgtggttactgcttgtttgcttgtccgtttggtgcgccgcagtttccgaaacaggcggcgtttggtgagcgcggtaagatggacaaatgtaccttctgtgctggcggccctgaaacagagccgggttcggaagaggaacgtcgtaaatacggagccaaccgtattgcggaaggcaaactgcccatgtgcgcttctctctgttctaccaaagcactgctagcgggggatgcggagaaaatctccgatattttccgtcaacgcgtagtagaacgcggtgcgaaaggtgccggttggacgaacggtgaagatctcgcctatgacgcaactcggagttaagtggctatgagacaacaactttctcgcgccactcgttttgtgctgcctttattggcagcactgctgtgctggttggctcaacccgtgatggcagaagagaacgcaaaaccggatgtggtgcaaaaagagatgacccaactggcgggtgcagacttttggcgtcaggtacgacaaggcgaagcggggtacaccacgtctcagtctcctgaacatggcgtgttgatcagtaaaccgggtgaaacttggtttatcctcaaagagaaatggatgtctccggctggtgcggtggcgattttcggcagcatagcaatggtcgtgctagcgtatatcgcagtcggtccgctgatgctgagtaagccgcgcaccggacgtaagctcaatcgctggtcacgctcagatagggcgctgcactggagcatggcgtttaccttcctgaccttggcattcagtggcttgatgctggtgtacggtaagcacttcttaaaaccgtatatcccgagtgagctgtggggctggatcatctatgccgcgaagcagtatcacaactacatgggaccactgtttttcattttgctgatgtttgtactgctcaagtggtggcgcaaatccatcttcaataaagtggatgtgcagtggtttatgaaactcggtggcatggttggaaaatacaaaggcacacatccttcagcaggcttttccaatgctggggaaaaagccatttactggttactgattgtgtttggaacctttgcggccattagtggtttggtgctcgacttcccgatctttggtcaaacacgtcgtgatatggaactgtcgaacctcattcatatgctctcagcgttgatcttaatctgtggctttatcttccatatttatatcggtctgtttggtatggaaggcgcattagaaggcatggtgaccggcaaagtggatgaaacgtgggcgaaagagcatcatgacctttggtatgaagaagtgaaacgccgcggtgaaattgaagaagccagtacggaatctcaaccggcctcattcaatcaaacgaaaggagaggtgagccatgaatcaagatagagcgcacaagtcagtgtggtttgtctacattgcaagcttgctgacgccattcacctgcttgctctcgggcgtgattggcattatctatgcgggttatcgattggataagaaccaagacggtgagatagcgaattcccattactatgggctcattcgcagtttcttcctctatctcacattctttgtggtattgattgtgacggtagcgaccacgaacggcattatcatgggtgtgaatcgctactggatgccggagcattggcttgccaaacttgggcatggcattccttatgtgggcgcactcattgccgttggagccatctctatttggatctggcggatgatccaaggcatgcagcagtatcaaaataacttaccgcattctccctccaaagggccgaatttgtaatacaggtctagcgttcaacacccagcactcgctgggtgtttttatccttgttactactatggtctaatccccgtattctagggttgataacgcttcggtgttaagcttaaacaaaagccgagaaaaggaatgggttatgagcttaccgtatcgacatgttgtgatactgactggagcaggcatctctgcggagtctggtattcaaactttccgtgctcaggatgggctgtgggaaaaccatcgaatcgaagatgtggcgacacccgaagggtttcagcgtgatcccgatatggtgttggagttttataaccagcgccgccgtaagctactctctgacgctattcagcctaaccctgcacaccttgctcttggcaaactggaaaaagagttgcagggcagtgtcactgtgattacccagaacattgataacttgcacgaacgtggcggcagccagaacattattcatatgcatggagagctgctgaaagcgcgctgtcctgagtccaatcaaacggtcgagcaaaaagaggatatccgtcatggcgatctgtgccactgctgccaaatgcctgcacagatgcgcccacacattgtctggtttggtgaaatgccgctacgcatgggcgatatttacgccgcgcttgaacaagcagatctgtttgtgtctattggcacctctggggtggtttatcctgcggcggggtttgtgcatgacgcacgtatgcatggcgcgcacaccatagagatcaatttggagccaagtgcagtggaaagcgagtttgctgagaagcgctatggtaaagccagtattgaagtgccaaggttagtggaagaaatcttagccgctcaggcgcgagcgaaagagagtgcagcttaagtgccgttggttatttatgtgatgacttgagcaagaatacttgcatttaactcacagcaacaacaaacgccccaaaaacggggcgtttgtttaaagcgaaactgtgtacttcaatacacgtgttttatctcaaactattcgcggaagttattgtattgcagcggttgctcaaggttggcctcgcgcagcatcgccatcacttcttgcaaatcatcgcgctttttgcccgtgacgcgtactttgtcgccttggatcgaagcttgcactttgattttggcatctttgatcagtttgacgattttcttcgccagtagcgcttctaaaccttgcttgaattctgcttctttgtaccagtttttaccgatatgcacagaatccttggctttcatcgcacgagcatccacaccgcgtttggcgagattaccgcgcaaaatatccatcatctgaccgagttggaaatcatcttcggcggccagttttacggtctcttctttcagctcaaagctcgcatctacgttacgaaaatcaaatcggctagcgagttcacgcgttgagttttcgactgcgttacgcagctcaaccgcatcaatttctgaaacaatatcaaaagaaggcatgaggtatttccttaatgacgagaacgacggactttgatcgattgagccagcatatcaagcatggtggcggtatctttccatcctaaacaaggatcggtgatcgacagaccataagtcagattattgagatcgtgcattggctgattgccttccacaaggaagctttccgccatgatgcccgcaattttgtggctgccagcttcaatttgctggcaaatatcgcgcgcgacatccacttgtttacggtgttgtttttgacagttcgcgtggctgaaatccaccactaaacgctctggtaagttgaattgcgccaactgctggcaagcttcattaatcgaagccgcatcaaagtttggtccgctatcaccaccacgcagaataatatgaccaaatgggttaccactggtacggtaaaccgtcatacgaccattcttatctggtgaatagaagtaatgtgacgctttggccgcgcggatcgcatcaatcgcgattttcacattaccgttagtgccatttttaaaacccacagggcaggagagcgcagaggccatctcacggtgaatttgcgactcagtggtacgcgcaccaattgcgccccacgtgataaggtccgcgatgtattggcctgtgatcatatcaagaaactcggtcgcggtagccaatccgagcttgtttacatcaagcagcaactttcgcgctttattgagaccggtttctaaagcgtaagagccatctaagtttggatcggtgatcagtcctttccaacccaccacagtacgtggtttttcgaaataggtccgcatcaccacaaaaagctcatcagtatagttttcttgtagcgcagcaaggcggcgagcgtagtcgagtgcggcatcggtatcatgcaccgaacaaggccccactatcactaataggcgatcatcttcaccggtaagaatgctttcaatttggcgacgagactgcgcgatccgtagcgcaacttcatcagtgataggatgtgcgtgacttaattctgccggagtaggcataggtcccaatgcttgggttcttaattcatcggttttcagtggcataggagcgcctgtccttttattgcgaagcgctaaagataacgaatttgtcaacgagaataaaccattacgccgaaaacagctgcggaaaggggtgtaaattgaagtaaaaaccgagcatttgaccaaaccgcctgcgtaaccccatcacaaccaagcagacttatctcttcactttgctcagaaagcgtcgtggctcagcattttgttaacatttgtttgacatttattcggcgatcgattgaagtggtcggacaacttactattgcggagtttttatgctgtcacccttagcaaaagccaacctctgtcttaatctgttcggctttttcaaagtccctttgatctgggcgtgtcgtccgaaaattctttcgctaaacgatcaagcggttgaggtgcgtatccctctgaaaagacgcaataaaaatcacctcaatagtatgtatttcggtgtacttgcggtgggcgccgatgtcgcgggtggttacatggcgatgcacaaagccaatcaacgcggtaaatcggtttccttggcgttcaaatcggtgagaggcgaatttcacaaacgcccagaagctgcggtgcattttcattgtgtagaaggtgagaagattgatcgcatgctagacgaaacagcgcgtaccggagagcgggttaaccaagaagtacacattattgcgacctgtcctacgctgcatggtgatgagccaatggcggagttttggttaaccctttcactgaaaatcgttaagtaagtggaatagattcgatgtccacaattcgactacggttcaacacgattttccagcggtagtaagtcggctcacctttatggtgtttttctttcgcgatcagatttaacagatggcgtttttccaccgattcgcgactgacttgtccgttgttgagctgataaatatgatttgagcctttatccatctggcgcatgatggcgcgcaaatcaatcatcatggtttctcgtgtctcttcatagccactcatgaaacgggatgtcgacatttccgtatgagaacgataatgcaggatctgttcttcacgttgcacaatacgttttttccgaatcgcttgaatgcgatccggcagctcacttagctttttgtaatccagccactcttctttgtcgcccacttgcttaccggtcgtcgggtcgaagtagtgacgtcgccattttgcttttcctttgcttatccagcgccacagcatatcgcgcaggtcgtctttaaagatttcccgaagagcatagataaaggacatagcaatgatgaatgaggcggtaatttctccccagtagtcacgcgcggaaatggcggtaatggtcactgccaccataactaaacctgttgctaaacctttcaccgcacgtttggtgttattccccagcgatgacactttttcattgaggatgaccgggtgctcaatcaggcggcgcagtaaccgcattttattactgagacgagtaatatcatggttggccttatctgagttgtactggttaagggtgcgatgtgcttgctctttctcaaccagcgtgatcaacctgtctttaatggttttgtattcattatcacgggtcatgtgcgcaatcatggataagaagctctgctcagtgtaccaagagaggtagttatcaatgttggcgtagtaacgcttgagttgctcttcgtaaggaatactgcggcgcaggcgacgcaaaatatccagcgaaagctcaattacgctatcgacttcttctgccgtcaccgtatcgctggtgttgttgagctgagaaaccgctttatccaacgcaatcacatactgataagcaaacaagctcaagctcacccgatattgggtcgtcgagagatggccacgttgagcaaggcggctgtgaaccagaggtaaaaggatctggtcgctgtaataggcacgctgctggtggattgaactgtagaaaaactccgactccgaaatgacttcgggtgaaatatccaactcgccaggaataaagagatacaaattaagatcgagctctttactgcccgtcatctggctgacaatcgtcaaggttgccgcatcttgctgttgtacggtaatcaacgaaaactcctgtaaaaattgcccgatttattgctcgaatgcgagaaagcataacagagataacgtataatctctgcaaatttgctgtgagacagttttatatgattaacattggtcaaattaatagtttagaagtggtgaaattcgccgaatttggtgtttttttggatgcaggagaatacggcactaccttgctgcctaagcgtttcgtgccagaaggtattgaaattgggcagtttattgacgttttcttgtattttgactctgaaaaccaactcgctgccacaactgaaacgccaatcgcgcaagtcggcgagtggggcttaatgaagatcgagggcgtaaatagcactggggcgtttgccaactggggcatcaaaaacaaagatctgcttattccatacagtgagcagcgtgcccgttttaccgctggccaaaccgtcttagtttacgtctacaccgataaagcatcggggcgtattgtcggcacaaccaagttcaacaagtggcttgataaaacaccagcgaaatacacgccaaaccaacaagttgatttactgattgcggaacgttctgaacttggcttcaaagcgattgtgaatggcacacattggggcatgattttctcctcagatgtctttggcaagctgttcatcggtaagaagctcaagggctacatcaagagtgtacgcgaagatggcaaaatcgacctgtccctgcaaaaagtaggggtagaaaaaatggatgagctcagtactaagatcttagaaaccttagagaagaaaggaggtttcttaccgctgagcgataaatcgacacctgaagccatttttgccacttttcgcaccagtaaaggcacgttcaaaaagaccatcggcggtttgtataagcaaggcaaaatcgtcattgaaaatgatggaattcgtttagcctaaccctatctttcgtaaaaagaacccgaaaaaaaggcccaaaacgtaaggttttagggcctaggggaatggctccaaagagcctgcgctaatggaaaatctagtcagttgcttagttctaagcctagtacagatactgaaattagcgacaggtttttagaatttaatactatagttcagccaatcaaaatagatttttgtctctaactagctctcttggcagtccattcttcacgcgattgcctacccattttcctaacccaatcacatcgttagcgtaacggatgatcacttcgccttgaccactttgtccttctggtctgacatctctgcccataaaccattctcgtgcttgcgtggtatccagctcgacactgtgactcgcacttgaggatgcaagacaagtcgccacttgatgctgccatcgataacccgatttatgtgcttcagcaatttttattcccatgcgagaaaagcgtagctcacccaataagggctctaaagcttcggggaatagccacacatcattatcgcgcaaccagacctgtgcatccgagggcagctcgataccaagagacttgtgaagttgctgagcaatctccgcttgctgcttatggctcgctttgttaaacggaaacttgcctaatcgcttgttgacctctggcgttggcacggaggctagtttacgaattttcgcgacaaaaaagccttcacaatcgtacatttgcggaaaaatgtgcaggaagccttcttcggtaagggcgagcgatgcgtgctcaaataaattacccagtgattcaaagctaaccgcatcaccatatgtctgctttaagtgccagcacacttgctgattttcttcacggctcaaggtacaggttgaatacaccagcgtgccgcccactttgagcgcctgaaatgcgctttcaattaaggctttttgagtgttggcaatactttgaatcgactcaaggctccagtttttcatcgcatcaggatctttgcgaattgtaccttcaccagagcagggcgcgtcgatcaacaccgcatcaaaacgctcaggcaaccaacctccaaacacacaaccatcaaaattacttagtgcggtattacgaatcccacagcgctcaatgttggcgtgcagcactttcactcggcttgcggaaaactcattggcaaccaacacgccttggttgtccatcaaggcggccatttgcgtggttttcgagcccggagccgccgccatatccaacacagagtcatagtgcgcattccccataaacagggctgaaacgggcatcatcgaactggcttcttggatataaaacagcccagccatatgctcagcggtattacccagcgggactaagctttcatcggcatcaatccaaaacccattctcacaccaaggtactggcgtcagttgccactctttctcagcggcgcgctgacaaaactctgcgacagaaattttgagtgtattaacgcgaatacttttgcgcagaggcctttggcaagctgcaataaaatcagcaagctgagtgggatctggcagtattttcgccatcgacgcgatgaatggttcgggaagggaaatgttcggatgcacaagcgagttccgtagatgaataagggcggcgattataaccagataaggcggtgacataaaggatcgccgaaaagtagaaaagcagcacaaggctgcttttcttcacgttatcttttgcgactaaggcttagggatcggtgtgcgccacttggtccattcctcttgggcttgagggtagaggtagaaagtatgcccttcaggcgccgccggcgttagctgtttctgctctggcgtcgcgaaggtgatcccgccgcgcaacatgctgtcaaaagtaccggctttcacattcgcaccagtaataccaatcgacatatcgagcccagagacattccagaatacgctgttttgacgcagcaaataggtgtactgcggagctatacgaatggtggtgatcacgcggtcggcaaattcacctaaacgtacatcaatcactttgcccacttcaatatcacgatacagaatcggggtgcccacactcaccgagccgcgtttttcactctgcaaagtgtaagtattgccagcaccaccatggcgcgcctctttgtgcagttcaaactcaaaacgactttcaccattgccaggttgtacttcaatgctttgtcccaacaggttctgcacgttttcaataccgcttaggccaattttggcttgcgaaagccagaattgtgaattctgcttggcaattttcggggcgtattgtggctcgatacgcgcggcgagtttgacgaaatccgattcaaaatcaggaatgatttcaaatacctcgccaatttgtacgccttggtattgcactggcgtgcccactttgactcccaatgtgccaagtgcggtcagcgtgattttctcaccatagcgacgtgcatgatcatagtcgctgtagagtttccacatcgaaccgactttgttttcaattccgggcagattatcaaaggcgatgccaccacggatcagagtttgtaatggtgcggcttttacatctacgccatccatcgacgctttgatttctacgccagagcggttccaaaagaccgtatctggtgtcaataaatgctgatactgcttttcgatggtcgcttcaatctgcacgcctttaggcgtaagagtaaagcccgagatactgccgactttcaaattgcgatacaaaaggggagagccagcattgattgaaggcagctcatgagcaaacagcgttaatgaacgagagcctgactgattgtatttcgccaattcagccagagactgactcgagtagagtcgatactgttcaagcggtgtgctactgccttcactggcaaaactgatcgacccaagcaacagttgtttcgcaggtggaatagaaacagaaagtcccgattccgtaagctcagccgctgcacttccagtgacgtagaaacggttttgggagcggatcaacgcgccatattgctcatcaatcaatacgttaaactcaacataatcgagtttaagattcacggcagtaacgctacctacggccacgccgcgatacaaaatcggggttcccgcttctaaaccaaatgagttatctgccacaagattgaaactgatgctgttggagcgcgcatacttaaattcatttttgcgtacggcctgaaagttacgcgtgcgctctccggctccggggatcagggtgaggtagttacccttcacaagattggtcaggttttctaccccagttaaagagacttgtgcttcttcaagaacaaactggctgccctgattcagcatatcgctaaacgcaggctgaatcgcagcagaggccacgatacttttgcggttttcggttagctgtaaatcggtaatttggccaatctcaataccacgatacatgatgggggcgccggacgctgagatgttgttgtcatccggtaaagtgatcgataccgcaataccgcgccccgcggtttttaaatcgcgatacagacgaaactgcgcattttgctctacgggtttgccttcatcaggtgagtcgaccgcaatcgagccgccaatcagcgcgcttaagctttctagacgaacatcgaccccttcaaagccgatactggcaccaataccactcacgttccaaaagcggctttccgtattaatgatgtgttggtactcctctttgatcgaggcttggataatcaccgactgcgcatcatcatccaactgatagctaaacacttcaccaatcgggatttttttatacacaatctgcgagccgaccgagatgccacctaaatcgcgagctttgagagaaatggtcaagccgcgttgtgccagtagatccgagggggctgagtccagtgcttgatattgtgttggataatcctcttgatgcgttgaacccggttggatcgcaatatagtttcctgatacaagcgcatctagcccagaaacgccggataaactcgccgtcggtttgaccatccaaaaacgcgtttgattggagagaagcttagtggcttcaggataaatatccgcctcgacgtagatgctatccaatccttcagagagtttgatgtcgcgcaccatccccacttccaatccttgatagcgaatggtggttcgacctgcgattaagccttgcgcgttttcaaaatgaatttgaatccgcactccagcatcatgcaccgctttaaacaccagccaacccgctaaaatcatggtcactatgggtaagatccacaacggagagatgccccgacgtttgcggatttccggtgtgtatgacgtttgcgttgtattttcttgactcattcaaacaacctattgttgagtacgagtggagtcgggctcatcccacagtaagcgcggatctaaactttccgcggctaacatggtgagcaccacgaccataccaaaagcgacagccccgtaaccgggagtaaaatcgaggatctgacctcggtcaaccaatgtcagcatgatagagatgacaaacagatccatcaccgaccatttgccaatccatttgatgccacgataaatcatcatacgttgacgctgatgcacgtgacgtttcagtttgatggccattaagagataggcgaggccaatgattttgatcacgggaaccacaatactggcgacaaagatgatcagcgcaataccccacatgccatttttcacgagcgaagccacaccagaaaaaatcgtatcttccaagcgctgaccattggtgatcaaaatagaaatagggatcaagttagcaggaaaaatcgccaccgttgctgctaaaacataagcccatgttcgttctatagagttaggttttctgtggtaaagcttgtgctgacagcgaacacagtgaccattttctggctgtgaaaggtggcagttatggcaatgcacctgcttgacgggcaaatcatattccgtttcagcttgccaggtttcccaatagcggcgagtactgatacgactaagcagtaagaccgtaaacagttgcagaagcaccaaccctaataatccggggccgataaaaatatcggagtaatcttttagcttaaagcaggacacggccacgctaaccaggaacacatcgatcatgacccagactttgagatgatgaataaagagcaatgagtaacgcagggtctgaaaatagcgaaaacgcagggcgagatgagcactgactacactcaaacataaaaccagtggcgcaatcgagctacaaaacagcaccaataacgccaaggcgatgtaaccttcatcccacaaagcgaatacaccttgcggcaaggtggctgggatcatcacaccaaacagtcgaatatcgatgtaactgaaaaagtgggaaggaataaacagcagcaaacaagtgaccgcaagagcaagatcgccggagagagaagggctaccgccacgataaagtagcgtgccacaacgggggcaatgagcgctgtgggcttggtcaaccgtaatcgcatcaataggcagttcgcagccggggcacaaacgaacttgacccgactgcgatgcatgatgagataaagaggatgaggaggtcataggcggacaacacaataggagccgccattaacaccattagtaacaccattagtgctgcgactgaacactcccataaagggtttggtacaagccttcttgttcgagtaactcgtggtgagttcctgactggctgacatgtccatcttccaatacataaattaagtccgcttgtttcaccgctgagaggcgatgggcaacaatcaaggtagttcgaccatgcaaaaactttgacaacgcaaggtgcaatgcggcttcagtagccgtatccaaggcggaagtggcttcatccaaaataacgaattttggattactcagcaccatacgcgcaatcgctagccgctgtctttgtccgcctgacaatcgaatgccattacgaccaatttggctctctaacccttggtcgagtttggtgatcacatcttgcagttgggcgatgtccaacgcttgccacaagacatcatcgctaaattgaccaccaagggtcagattatgccgcaaagtgtcattaaacagtataggttgttgtaaaacaacggcaatttgatcgcgaatcacgtcaaagctaatgtcatcacagtgttgtccattaaagcggattgcgccactttgcgcgcgataaacgccaattaagagctgaatcagcgtcgatttccctccgccactggctccgactaacgccacctttttccccgctgggatatgaagtgacaaatcattcaggacttggctttcaccatcgtaggagaaatggatattgttgatctcaatatcgacttctcccagctgagtaaagggattgactttgctgatgggtcggtactcttcttctagctctaataagctattgattcttttcaaagcggccttagcggcataccaagaaaactgaatacccaacagctcttgcaccgggcttagcataaaccacaagtagccaaataccgcgaaaatctggcctatggtgaggtcactgaacaccaccattaacatggccacagcacgaaacagttcaaaaccgagtaaaaacagtaagaaggagaggcgaccagcagcttcagattgccatgcgtatttgtcagcgttttcgcgtactgcgtccgcatcgctgatgaggcggttgaggaactcgcgctccttgtttgcggcacgcaactgatagataccatctaacgtttccactaagcggttttgaaaacgctcaaacgcttggttttcgcgttttttcaaatgtttaacttggctgcccagcattcgagaaaagtagataacaatcgggttcactaacagaataaacaggccaagtcgccactccaaccaaagcaatacaatggcggtaccaatcacagtaagcaaagaaatcaaaaatttactcagtgtcgagccaataaattggtcgatggtttcaatatctgtgatgaggtgagcgttaatcccgccactgccgcgcgtttcatactgacgaatactgatccgccctagcttttcaatcatcttccgacgcatttcgtaagtgatggtcttagaaaccaaggtgaactgacgactttgtaggatattcaacaactgactggcaatacgcatcaccaccaccatcagcaaagtcagcatgatgtaacccgttgcggtctgccacccttgtggcaggaactggttcatcacctccacaccttttgccggatgattgagcagcacttcatccaccattaacggcatgagcagtgggataggaacactgattagcgtcgcgacgacggcaataaagttagcaaacaacagtttggcgcgatgtttttttacttgagttatcagccaagagcggctaatagtgtcgttgaaatacgtcatattaatgagaatgcatcctattttagtgatgcgcattgtacgtagttcgcgaagtgaagtctttatttttcaaatggaagttattatgaacctagaacagtaccaacgcctcaccaagcaagcggtcgctttattagaaggtgaaaccaatctcatcgcaaaccttgccaacttaagtgcgttactgaatatggaactcaccgagctcaactgggtgggtttttatttaatgcaagagaacgagttggtattgggcccatttcagggcaaacccgcttgcgtgcgcattcccgtaggcaggggagtttgtggtactgcagttgcagaaaataaggttcaacgtgtgtacgacgttcatcaattcgaaggtcatattgcttgtgatgccgcgagtaactcagaaatcgttatcccattctcgattaacggaaaagtcgccggagtgttggacattgacagtccaaacattggtcgtttcagtgaaattgacgagcaaggcctaacctatttgatgagcgaagtagaaaagctgctcaattcacaggctaataaggcataaattgccctttgcctgtggtttttcctttgcaggtctttataataccgcacatatttacacatcaatgtttggcgggcagccgcaataaccaggaatcctcatggaaaacactgaaaagttaaaaaacagcaaagaagtgatcgcgtacattgctgaatgtttccctaactgctttactttagaaggtgaagcaaagcctctgaaaattggtatttttcaggatcttgctgatcgcttgaatgacgaccctaaagtaagcaaaactcagcttcgtgccgcgttaagacaatacacctcttcttggcgttatttacatggtgtaaaacctggcgcaactcgtgttgatttggacggaaacccttgtggtgagctggaagaacagcacgtagaacacgcacaagcggcactggcggagagcaaagctcgcgtagaagctcgtcgtaaagaacaagtaaagaaagtgcgtgaagaagcgaaagcgaacaagccaaaggcgaaaaagccacagcaagctcgccgtccgcaaaacgcaccgaaagtggagaaaaagcctgtagaaactcgcgcactggctgcgtctgagcttaacgttggcaatcaagtcaatgtgaatatgggtaaaggcaacatggctgcgaccatcgttgaagtcaataaggaagatgtgcgtgttcaacttgccaacggcctacaaatggttgtgaaagcggagcacttgcgcgcataaaggagatactcctacgcatgaaatgccgttcaaaaatatctctgattgctgctagcctatggctggcagccttttcagctcaggctctagaagccaaactcaaaccagaagatctccctcttcttgttcctgaagctcaacacgcaacggcagcgaaacgtgttacctcacgttttacccgttctcattacaaacaattcaatttagacgaccagttttctcaagccatgtttgaacgctaccttgagatgctggattacagtcgaaatatctttactcaagcggacatagacagcttcaaagcttggtctttgcaattggatgaccaattaaaagcaggtgacaatcaaatcgcttacgatctgtataacctgtcaatggaaaaacgttttgagcgctttcaatacgcactttctctgcttgatcaagagatgacgtttgatgctgatgagtctattgagcttgatcgtacgaaatcgccttggccaaaagatcttaaagagattaacgagctgtggagacaacgagttaaatacgatgcgttaagcttgaaactggcaggtaaagagtggccagaaatcaaagaaacgctcgataaacggtacaacaatgccatcaagcgcctcacacagacaaaaagtgaagacgtatttcaaacttatatgaatgcgtttgcgcgtgaagttgatccgcacaccagctatttgtcaccgcgtaacgcagaacaattccaatctgaaatgaatctctcgttggaagggattggtgccgtgttacaaatgaccgacgattacaccatcatccgctcattggttgcaggtggtcctgcagcattgagcaaacaattgggtgagggtgaccgcattatcggcgtcggtcaagaaggcgaagatgtggtagatgtagtcggttggcgcttagacgatgtcgttcaactgattaaaggacctaaaggtagcaaggtgaaactgctcgtgttacctgaaggcaaagacgcaaaaagtcacgttgtcactattgtgcgagataaaattcgcttagaagatcgcgccgtaaaatctgaagtgattgaaaaagcagggaagaaaattggtgtactagaagtaccgagtttctacgttggcttagctcaagacacggaaaaactactggcggagctaaaagcgaaaaaagtcgacggcatcattgttgatttacgcaataacggtggtggtgcattaaccgaagctaccgcgctttctggtttgttcattaccagtggccctgtagttcaggtgcgtgatagctatggtcgagtcaacgttaactcggataccgatggtagcattagctatagcggaccaatgaccgtgctgattaaccgctacagtgcatcggcttcagaaatctttgctgccgcaatgcaagactatggccgcgcgatcattctcggtgagaactcatttggtaaaggtaccgtacagcagcatcgctctctcaatcatatctatgatttgtttgataaagagcttggctacgtacaatacacgattcaaaaattttaccgtattgatggtggtagtacccaaaacaaaggtgtcgtccctgatatcgcgtatccaaccgcgattgccccttccgaaacaggggaaagtgttgaagataacgcactaccgtgggacagcattgataaagcaaaatatgagcgtttgaataacttcaacaccatcattgctagcttggaagctaaacaccaacaacgtgtcgcgaatgatttagaatttggttttatcgagcaagatattgcgaaataccgtgcagagaaagatgacaacctactttcgctgaatgaaaaagtacgcaaagaagagagtgctaaggctgatgaagagcgcttagctcgcatcaatcaacgccaaaaagcgttaggtaaatcgacctatgcgagcttgcaagatataccgaaagattatgaagcaccggatgcttatctcgatgaatcggttaacattatgcttgacatgatatcgcgataattcattgatttactttatctttaatcaaaacggacctcatggtccgtttttttacacttttttaattcgtaaaattaatgtgatgaacatcaaataatttcgcatttcatgcactcaatgcctacgcttacaaaaaatgtgaggagaagtgccatgaaatggatatttacttgcgtgatgagcttactttttaccgcctcatcaccgtttctcagtgcaaataatcttagccgtgccgacttaactcaatttgatcaacctttattgctcggcgactggtatttgctcaatcccaacccagagcaatctagcgaaaactttcgagtcattaagctcagtttggcttcggactaccatttctcgattgatatccaaaagaaagatttcagtgttgaccactggaatggcgcttattctgcagatgagaaaacccttattctcggcctagatagttcagatccccaaacttaccagtatgaaaataaccatcatttgctgacattgaatggtgtaaccttcactaaaggtttacccaataccttggccggtagctggagcagtgcacatatcaaagatcttgatggcgaaaaccttgaccaaagcctgatccaattaaccttacagccagattttatcttctctttccacatcactaatcaagatggtaacgaggccacccatcgcggcgtctattacactgaaggaaatcgcttggttttgctctattcggaaggtgagcacgatacccgttatgtgctcgatcaagatagactcaccttggaaattgatgacagcatgacggtcgtcatgaaccgcgtgcaataacactcatgcggtatgccacctgttttgataatgggcggccaaaaagcaaaagtggcagggagtttacagataaactccctgtttttttgcgttcagggcttgttattcattcactgcggcctaagatcttgcttcaataacgcttttcttcctgtattcattaacgtcacagaacataaagtcaaaaggattacgacaatggctcacacacctcaagccaaataccgccttgattaccaaccgccttcacacaccatcaccgatatcgatttggtgtttgatctatacgatgatgccactctggtcaccgctgtctctcaagtaaaacagcagcaggagagcaataccttaattcttgatggtgaaacgcttgaactgaaagtgctcaaagtcgatggccaggattggcaggactacagcgtaggtgaagcttcccttgaaattcgtggtttgccgagtgagtttactctcaccgtcgtgacaaaaatcaatccgcaagccaacaccgctttagaaggtctttacaaatcaggtggtgcattttgtacccagtgtgaagccgaaggctttcgccgcattacttattatttggatcgtccggatgttctggcgcgttacaccacaacggttattgccgataaagcgcaatatccttacttactgagcaatggtaacaagattgcacaaggcgagcaggaagcggggcgtcattgggtgaaatggcaagatcctcatcccaaacctgcgtatctgtttgctttggtggctggggattttgatgtgctgcgcgatcagtacgtcacacaatccggccgccaagttgcgctagaaatttttgtcgataaaggcaatttggatcgcgctggtcatgccatgacgtcactcatcaactctatgcgttgggacgagcaacgttttggccttgaatatgacctcgacatttacatgatcgtggcggtggatttcttcaatatgggcgctatggaaaacaaagggttgaatatctttaactccaagtttgtcctagccaatgagaaaaccgccaccgacaccgattacctcggaattgaagccgtgattggtcacgaatacttccataactggacgggtaaccgtgtgacatgccgtgattggttccaattaagcttgaaagagggcttaaccgtattccgcgatcaagagttctcttcagacttaggctcacgagccgtcaaccgaattggaaatgtgcgcatcattcgaggcccgcaatttgctgaagatgctagcccaatgtcgcatccaatccgtccggataaagtgattgaaatgaataacttctataccctgaccgtttatgaaaagggcagcgaagtgattcgaatgatgcacaccttgctaggtgaagaaaaattccaacgtggcatgaagctgtactttaaacgtcatgatggcaccgcagccacttgcgaagatttcgtggcagccatggaagaagcttctggcatcgacttacaacagttccgtttatggtatagccaatccggtactcctacacttaaagtcagcagtacttaccatgccgcaagccaaacttatgagttaaccgtagaacaacataccgagcccactcacgatcagaaagaaaaacaaccactgcatatcccgctggatattgaactgtatgcaccaaacggcgatgtgattgcgctacagtgtaacgggaagcctgtttctaacgtgttggatgtgaaacaagctaagcaaaccttccgctttgagcaggtcaaacagccgccaattccgtcactgctgcgtgagttttctgcgcctgtgaaattggaatacgcctacagtgatgaagagctgattttcctgatggtgcatgctcgtaacgaatttgcacgttgggatgcagggcagatgttgcttgctaaatatattcgcaccaacgtagaacgagtccaacgaggtcaacctgtcgaattggcagagtcggtgattgacgcattccgcggcgtgttactcagtgacaacctcgacgctgaatttgtagccgaaatgctctcgttaccaagccataacgaagtgtcaggctggtataagcgtgtggatgttgatgcgattgcccaggtgttaacctcactcaaaaccattttggcgaccgagctagaagatgagctcagtgcgacctaccatacgttaaaacaagatacttactcgattgaacatgcggcgattggtaaacgtacgctgcgcaacgtgtgtttgagctatcttgcctacactgcccaaggtaacgcgttggtacaaaaacagtacgctcaagcgaacaacatgaccgacaccattgcggccatgacggcggctaaccaagcgcagttggcgtgccgtgaaagcttgatgcaagactacagcgagaagtggaaacacgatggcttggtaatggataagtggttcacgctgcaaggctcaaacccatcaccacaagtgttggatgtgatccagcaagccatgcaacatgaagcgtttagcttgaaaaacccgaaccgtactcgcagtctgattggggcatttttaaacgccaatccagtcaatttccacgcgaaaactggggaaggctatcgctttgctggacacattctgcgtgaacttaacagtagtaacccacaagtggcttcacgtttgattgatccattacttaaattccgactctacgatgaacagcgccaagcactgattaaacaagagctggagcaattaaaagcgatggataacctagcgcgtgatctgtttgaaaaagtcagcaaagcgctggaagcataaaccaaactcaacaggtaaactcggtggcactctgtgccaccttattttccaatgaactattattttttctcgctaaacatttcttatcaaacctttgttacgcattactcgggcgtagcaagtcatgtcatggtcaccaccgagcaaggtttgcgtttacaactccctgcaacacgtttgcgtccatttttaagccaaattggagtaaaaggtcgatttcgattaacaactgaccaaaataatcgtttcgttaagttagaagttctgtaaaagcattattttgtagtggtttaaataggtactttagtcacaatctcacacttttactccataacaaccccaaaacaattaactatttataaataaaactcttacaatacgccctgcattaccatcagtaagcgctatgcttactgcacaccccctacaaaaataagaatcaaattctggagtcgaccatgactgcgcgtgaaactttgatgccagttttgcttgaaaaagtttatcaactgattcaagacaaactagagcttgctcaacaacccttagtgactcaacttggacaacacctgttcagtaacatttcacaagacgacctagtggagcgtaacgaatcggatctttatggtgcagtgctcagtttatggcaccacatcaatgagaaaaaagccgatgaacgctcagtacgagtatttaacccaacggtaagtcgccaaggttggcaatcgacccacaccattgttgagattgttctcccagatagtccctttctggttgattcaatcaaaatggcattaagccgcctaggattggcatcgcacttaatgctcaacggacctgctcatattgcacgtcacgacgatggctcgatcaaaagcattaatcaaggagaagggcaactgacctcaatgttccacattgaagtcgatcgcctaagcagcaaggaagagatgacagagctgaaaaacgaattgctggatatcctgcatgacactgctctggttgtgaaagattggaaaccgatggcgaccaagcttgaacaagtgatcaatcagctggaagcggataaaaaacagatccctgtagaagccgaacgcctacaagaaaccattcagtttttacgctggctaggtaaccataacttcacctttatgggttacaaagagttcgatttggtagagaaaaatggcgataccgaactgacgccaaccaaagacaccggacttggcttattctctgacaatgagcgagtacgtagcgtaaaactttctcaattcccagattcagccaggctcgaagccaaaaagcctttcctgttgatcttaacgaaaggcaacaagcaatcgcgaatccatcgtcctgcttataccgactatatcgggatcaaaaagtttgacgcgaaaggcaaggtgatcggtgagcatcgctttactggcttatacacttccgctgtgtacaaccaaagtgttgaaggcatcccgctgatccgcgaaaaagtagggcgcattcttgcggccagcggctaccgccaaggctcttacgcctacaaagccctgcacaatattcttgaaaactacccacgcgatgagttgttacaagcccgtgaagaagagctgcttgaagtaggcatgggcgttgtacagatgcaagatcgtgatttactgcgcctgtttgtacgtaaagacccattcggacgtttcttcagttgcatggtgtatgtgaccaaagagcgttacaacactgagctgcgccgtaagacacaacaagtgttcaaacagtattttggctgtgagcaagatgttgaatttacaacctatttctcagaaagcccactggcgagaactcactacattgtgcgtgtcgacaataacaacatcaacgtagatgtgaaaaagatagagcagaatttaatggaagcctcaacctcgtgggatgatcgtctcgcagaagccattgtcgccaatttcggtgaaagtcgtggattaccgctgtcaaaagagtatcaacgtgccttcccacgttcttacaaagaagatgtgatgccgggctctgcactggcagatatcgagcacctcgaagcgttagatgagcacaataaactgggcatgctgttctaccgtttacaagagacagccaaagactccaaagcggtgcgcttaaagctgtatcacaaagacgaacccatccatctatcagacgttatgccgatgctagaaaacctcggcttacgcgtgattggtgaatcgccttatgaagtagtgaaagccaatggccaagtgtactggatccttgatttctctatgctacataagagtgataagcaggtggatctgcgtgaagcacgcgaccgattccaacaagcgtttgccgctatctgggcaggagagctggagagtgatggctttaaccgtttgattttaggtgcatcactgtcaggtcgtgaagtttcgatcctgcgtgcttatgcgcgttatatgcgtcaagtcggcttcccatttagccagcactatattgaagatacactcagccaccatcccgatcttgcacaaggattggtggatcttttcgtgcgtcgtttcgatccgaaatacaaaggcggagaaaagggccaagctgaaatcatcaaatctctgacagagcaattagatcaagtacagagtctcgacgatgatcgaattatccgtcgctatatggagatgatcaacgcgacgctgcgcaccaactactatcagttggatgagcacaagcagaacaaaccttggctatctctcaaaatgaagccaagtgagatccctgaaattcctgcaccagtgcctgcgttcgaaatcttcgtctatgccccagacattgaaggggtgcatttgcgcggtggtaaagtcgctcgtggtgggctgcgttggtctgatcgccaagaagatttccgtactgaaattttaggcttggtcaaagcacaacaagtgaaaaatacggtcatcgtgcctgttggtgcaaaaggtggctttgtttgtaagaaacagtatctctacaccacacgcgatgagatttttgcagagggccaacgctgctacaaacgctttattcgcgctttactcgacgtaacggataacattattgaagggcaagtggttccgccgaagaacgtggttcgtcatgatgaagatgacccttatttggtggtggctgcggataaaggcaccgcaaccttctctgatttagcaaactcagtgtcagcggaataccaattctggctcggtgatgcttttgcttcaggggggtcaaatggttatgaccacaaagcgatgggcattaccgccaaagggggttgggaatcggtaaaacgtcatttccgtgaaatgggcattgattgtcaaaccaccgattttaccgcgattggcatcggtgacatggccggcgacgtgtttggtaacggtatgttgttatcaaaacatattcgcctactggcggcctttaaccatattcatatcttcattgatccaaccccggattctgcgagcagttgggaagagcgtaaccgcttgtttaatctgcctcgttcaagttgggaagattacaatccgaagctgatttctaaaggtggtggtgtcttctcgcgtaaagcaaaagcgattacgctgacgcctgaaatgcagaagatgctcaacactaaaaaaaccacgttggcacccaatgagttgatcaaaatgatcctgaaaatggaagtcgatctcctctggaatggtggcattggtacctatgtgaaatcatccattgaaacacataccgatgtcggtgaccgagccaatgacggattacgtgtcgatggacgtgaagtaaacgctaaaatcatcggcgaaggcggtaaccttggtatgactcagcgcggtcgtatcgagtttgcactcaaaggtggacgcgttaacacggacttcgtggataacgtcggtggcgtagactgttccgataacgaagttaacatcaagatcttcctcaatggcttggtggctaatggtgatttaacactcaaacagcgcaaccagatccttgagtcgatgaaagatgaagtaggaagcatcgtgattgaagatgcttatggacaatctgaatcaatttccgtgaccgaagcgcagggcgtatcactcatgaaagaacagatccgctttatccatcacatggaaaaagcggggtatttggatcgtgctttagagcacattccggatgatgaaactctacttgagcgtgaaagacagggcatgggattaacacgtcctgaactttcggtgctgatggcctacggcaaaatggcgttgaaagaagaattggccagtgaagagattgcgcaagatgaattccatgccaaacaattggttaattacttcccaactgagttacgcggtcactatgcgcagcagatggtgaaccatccgctacgagtagaaatcatcgcgacagccttagcaaaccaaatggttaatgaaatgggctgcaacttcgttacgcgtttacaagaagagaccggctctagcgtggtcgatattgcgaatgcgtatgcggccgcgcgtgagatttacggtttaggtatcgtgctcgaaaaagtacgcaaactggacaacatagcgcaaagtagcgcccaatatgatgtcatgttcctcgtgcgtcgcactttgcgtcgcctgactcgctggttactgcgcaaccgtacaggtaagccatccgtgatagcaatggtcgaacgctatcaagaggatgtcaaagctatcaccgaacaattggataaagttttggtgaaagaggagattgttgagcataattctatggctgaaaactggatagagaagggcatcgagaaagaacttgcgcattatgtggcgcgtctttctagcctttactctgtactggatatctcagccgtggcgaaagagaaaggcatcgcagtcactcaaacagcgaagctttattttcatctcggcgatcgtttatctctgcactggttcttgaagcaaatcaaccaccaagccgttgataaccattggcaagcattagcaagagcctctttccgtgaggatctcgattggcagcaacgccagttaactgctcaagtgctcagtagcaatttgagtgatgctcaacaggaaattgaactggcacttgataaatggctagagcgtaaccaagtctcaataagccgttgggagaacatcctcagcgagtttaaagtcggtaccgttcatgaatttgccaaattctcagtggcattgcgagagttgaccttgctcaacttaaattgtctcactgtagaataagcattgaattgcctgacgaatgagtcaataataacgccccgtttattcggggcttttttctttcggaggcattatgctttaccgcttagccagagctggctttttccaattggatgccgaaaaggcacacgatctggccatctctaatttcaaacgtttcactggcactcctttcgatctcttctatcgtcaacaacttcctcatcgtccagttcaatgcatgggcttaacctttaaaaatccagtcggtttagcagcagggctcgacaaaaacggcgagtgcatcgaagcgtttggcgcgatgggcttcggatttgttgaagtaggcacggtcacaccaagaccacaagcaggtaacgacaaaccacgcctgtttcgtttagtgcatgctgaaggcatcatcaatcgaatgggctttaacaatctgggtgttgatcacttggttgagaatgttaagcgagccaaatacgatgggatcatcgggatcaacatcggtaaaaacaaagatactccgattgagaaaggggcagaggactatttgatctgtatggataaagtttatccttacgcaggttacatcgccgtaaatatctcttctccgaacacaccaggacttcgttctctacaatacggtgaagcgctggatgaactgcttgctgcattgaaaactcgccaagctgaattagcagcgaaacatgataaatatgtcccgcttgcacttaagattgcaccagatttaagtgacgatgaaattcagcaaatctgccaatcacttttgaaaaacaaaatcgatagtgtcatcgcgacaaacaccaccttagatcgttcattggttgaagggatgaagtttgccaacgaagctggcggcctcagtggacgacctttgcaaaaccgcagtacagaagttattaagtgtctgtataaagaactcggtgaagaaattccgatcatcggggtcggtggtatcgattcctacatctccgccaaagaaaagctcttagcaggagcaaaattagttcaggtctatagcggctttatttatcaaggaccagggctggtcgccgatatcgtcaagaacctgtaagttccccgatttatcagcggaattactgaggaaatgtctaacgcatttcctctttttttttctctgcaccttcatagaattactgatattcataggcaagggtaggtcacatagcttacctcatcctcccaaatgtatcgttgagagtggaacaatgcttaaaccaagtgacaaatggagttggtacttctcagatagcgaaggttatctgatgctcaaccttggtgatgatatgctgtttcgtaccaatctcagtcgcaatcttttggtggattgtgcattcatcgagaaccccttcaccgtagatgacgcttctgattttcagttgtacaaagaacacattgcctgtctacctctgagtgagcctcgtaaagcggagttggcgctgtactgtgtggccgcaaaacgcttccacaaacccgtacagcctaaaagctggttttttgatgtacagggaaccggttataccccacaacaaggtcagctgatatctctacgaaactcccttaacagcggtatttttattgcgttagaagtgggggagaacgccactctttgcgcgtacagtgatttggtttcttttgctttaaacggcagcaaaacactggaatttggtcaagtgattaaagtgatgcacgacagaatgtcggatgtgaatacacttttgtatacaccccaaatggccatggtcagttaattttttattcaacattcgttcctttcctatttcgttccttcatttcttatcggcgtaagccgattttttttgcctttaaatcgagctaattcgttaggcaatgtgagctcggtacaaaatttagacatctattttttacttaaacacagtgaaacagggcattcactttgtatttttaagtcggaaattcccgttttatgaccttttgtaacttatttacagtgtaaaaatgcatctggtatagtccaaaataagcatgaataagtagtcaccaacgagaataaatgcttagttagcaagcgttggaacaggagtgtgtacacactgaccgatatgatcggcatagagaggatcgaatggataaaagagagattttttggcttggtgatgagttagctttaggtatggttcacattgtcagttataatctgagaccatttttatcagcaaaagaacactatgaatcagtatctagcggtgacgtctaacggccttgagaatctattagttgaagaattaacccaactgggtattaacgatgccaaacccgttcaggccggggttaaatttaaagcaaccaatgaacagatctatcgctgctgtctatggagtcgtctcgcatcaagatttgttcgtattgtggctgaatttaagtgtcagaatgacttagatctctatctttcaacaacttcagtcaactgggtcaactatttccacagttctaaaaagctcgttgttgatttcaatggcacgaaccgagaaattcgtaatagccaatacggcgcgatgaaagtcaaagacgccatcgtagattgcttcactaagaaaaatcttccgcgtccgtcgatcagcaaagatcttgcggatcttcatatccatgtccgcttacacaaagagaatgctctgcttggtatcgatatggtgggttcaggcttgcatgctcggggctaccgaactgaagcaggtaaagcgccattacgtgaaacattagccgccgcaatcattctgcgcagtggttgggatgccagtaaaccgcttctcgatcctatgtgtggctccggtaccttactgattgaagcggcgatgatggctgccaatattgctccaggcttacaacgtaaaaagtggggcttcgaagcattagaagatttcgaaccagaactctgggcaagtgtgaaatcagaagccagcgtgcaaggtaaacgtggagtcaaaaaggtagaaactcatttctacggcgtagataacgataaccgcgtattgcagacggctaaagataacgcccgccgtgccggtgtagaagagctaatcagctttaccttgggtgatgcggcaaaagtaaaacgcccagaaaacttcgctgaaggtattgtgatttgtaacccaccgtacggtgagcgtttaggcactcatcccggtttgatcgctctttacactgcatttggtgcacagcttaaagctgagtttggtggttgccacgcttctattttctcgagttctgacgaattactcagttgtttgcgcatgcgtgcggacaaacagttcaagctgaataatggtgcgttaccatgtcaccaaaaaaattacaccatagccatgcgagagcaaaacagcgtcagcaatgaaggtactcaagaaatcctcattgcccccgattttgccaaccgtttgaagaaaaacttcaacaagattggcaaatgggctaagcgtgaggggctcgattgcttccgcctctatgatgcggatcttcccgaatacaatgtggctattgatgtctaccaagatcatctcatgatccaagaatatgcagcgccaaaggatattcctgaagagaaagcgaagcgtcgtttgaccgatattattcgcgcagccattcaagtgttggatgtcgatgcgaacaacgtcgtgctcaaagttcgtgaaagacaaaaaggcacgtcgcaatacgagaaactcggccagcaagcacagaccatgcaaattaccgagtatggcgtgaagttgatcgtcaacctatacgattatctcgatactggcttattccttgaccacaaaattactcgtcgtcgtttagggcaaatggcacaaggcaaagattttctcaatttatttgcctataccggctctgcgacagtacatgctgcttgtggcggtgcaaaatcgacgacgaccgtcgatatgtcgaaaacttatcttgaatgggccaaagagaacatgcagttaaacgggcaggttgggcgtcagcaccagtacgttcaggccgactgtctacagtggctcgcgaatgcccaaagccagtacgatcttatctttattgatccgccaacgttttctaactctaaacgtatggagcagacttttgatgtgcaacgtgaccacgtcacgcttatgaccaatcttaaacggttgctgcgcccagaagggacgattgttttctctaataacaagcgccatttcaagatggatatggaagcgctacacgctttgggcctcaacgctcaaaatatctcgcatcaaaccttaccgctggattttgagcgaaataaacaaattcataactgctggctgatcacccatcagagttaggaaattcaatgataaccttgtacagcactgaaggatgccatctctgtgagatggcctatgcgttactcaatgaagtagggctcaccaaacaagttgacgtggtagagattgcctttaatgacgagctattttctcgttacgcggtcactataccggttgtcgcttaccaaggtaatgaactgaattggccttttgacatacaagaattaagagagtggttaaaacataatggcattaattaccatccataacggtttgctggcctttggcgatcacccattactggatcacgctgatttcgccttacaagaaaatgaaagagtgtgtctggttgggcgtaatggcgccggaaaatccacgctgatgaaagtactcgcaggcgagattctgctggatgatggcaagatgcaagtcatgcaagatgtcgtcgtatcccgtttagagcaagatccgcctcgcaatcaagcgggtactgtatttgattatgtttcaggtggtctgcaaggcattggcgaacaactcaagatctatcaagatcaattagatctcgtagcaacagatccaagcgaatccaacattaataagcttgcacatatccaagagcagcttgaagtttctggtgcttggcgctttgaagatcgaatcaaaaatgtgctgggttccttaaaactagatggccacaccaaattaaccgacctgtctggtggttggcagcgtaaagctgcattagcgcgagcgctggcgtgtgatcccgatgtcctgcttcttgatgaaccaaccaaccacctcgatgtaacaacgattgaatggttagaaggttttctgaaagatttccgaggttctatcattttcatttcccatgaccgtgcttttattaagtctatggcaacccgcattgtggatctcgatcgcggtcaactcagctctttcccaggagattatgaaaattatcttactgaaaaagaagagatgctgcgggttgaagagctgcaaaatgccgagtttgataaaaagctcgctcaagaagaggtttggatccgtcaaggtattaaagcacgaagaactcgtaatgaaggacgagttcgggcactgaaacgtcttcgtcaagaacgtagtgagcgtcgtgaagtgcagggtaaagttaacctgcaaatcgatgattccaatcgctcagggaaaatcgtttttgaagccgaaaatcttcattactcgatcggtggcaaaaccattgttgatggtttcagcttcaacatcatgcgcggtgaccgaattgcgttaattggtcctaatggttgtggcaaaagtaccttactcaaaattttgctgggtgacttacagcccgatagcggcaaagtacactgtggtactaagcttgaggtcgcctactttgatcaataccgggagttactcgatcctgaaaaaaccgttatcgataacttagcggatggtaaacaagaagtgatggtaggcgggcgtcttcgccacgcgttaagctatctacaggactttttgttctcacccaagcgggcaagaaccccagtaaaagcgttatctggtggagaaaaaaaccgtttgctgcttgcgcgcattttgcttaaagccaacaacctattagtgcttgatgaaccaaccaacgatttagatatcgaaactttggaacttttggaagaattgcttgccaattaccaaggcactttattgctggtcagccacgatcgtgaatttgtcgataacaccgtcacctcaagttggatttttgaaggcgacggcaagattgaagaatttgtcggtggctaccatgacgctcagcaacagcgtgcccaagttttacaaagcagagctgctgaaaatatcgtcaaaaaagaaaaagtggttgaggagtctcccaaatccgcaccatcgaaaactaagcagaagaagttatcttataaactgcaacgcgaacttgaagctcttccgcaaagattagaagagctggaagttgagatcgcagcgttacaagacatcgtcaatagtccagactttttcagtcagcctgtcgataaaacgcaacccattttagacaagttaactgcaacagagcaggaactcgaaattgcttttgagcgttgggaagagcttgaagcgatgcaacaggaaagtgaatagaaaacatgagtcgtattacttttaaacgttcgattttagccagcgcagtattgcttgctacccaaacggccaacgcggcactctaccaagtgatggaagtgaccccaagcacagggcaaagctacggtagtgcatggggtgtggcgatccaaccaagtacaggcacagatagctgttttaataattcgactgtcggtagtgtgaattgtcaaaactttgctctggcaggtgaaactcgcattgaaaaagccagcacaggtaaagcagtcgatggtttaagttaccgtgatgaagtggctttcgggattgataatgcgttcgtttatgtacaagaacgcaatgactttgaacgctactgctacaacgaacttttgtattcaacttgtaatacctgggcagatccccattggaatcgctggcaagcagagatcaatagtacgcaagttgctaactcaattgcttttattggtactggaacaacaggcgcgcctattgatgagtcacaaaacgtgattgttaatagcctaacgagtaatgctacgcctatcgggatcaatgtaaaaactggtgacgtgacaacgtatcgtagaaacgctaatgccattcaagcccgttccaccgtcgcaccgaatatcactgatgccttatatacccgtgcatggaaaacggatggtgtttacaccgttggcagtatttcacgaagctcaaacaataacgaaggtgcctatttttattccaagcctgcaatttggaaaaattctaacggtgaaacagtagagctttcttggccaactggtaccgaacctaatcgcaataatcgtcttgcacaaggcagtatgcgtgatgtcgttgaaaatggaggtaagctatacgcggtcggttatagttcatacgatacagacaatcactacatgcaggcctcggttttcgaactagacaacaccagtaatttttctaatgcagcaagttggacgaccaaagccgtttccggcgctgaatctagaattggtggcgattacattcacagtaattcggtagtcaccgatgtaaacaaaaacctcgtcgcgttaggctctgctaaacgtgcaggtagccgcccagagaatggagccgcgggcaatcgattatttgttatcgaagatgtttctgctagcactccaacagcgaacttcttaaccggcggcatcttcttcacaggagccggcggcaaagcaggggcaattaacagctataacgagattgtcggtcaagtcgacgcaaacgacacccgtgagaatgatggtaaaccgcgccgtaaaagagggtttatttatccatacagtgccaatggcagtgatccaagccgcatggctatttttgctaataaggcttggttgttagatgatctcactaatgacaataccgcaacaggcaacaacaaccagttccgcattattgatgccacagatattaatgatgctggcgttatctctgcaactgcgctgaaatgttcaggtggatacgatacgacagcacataattcattgtgtagtaaccgcgaagaaaccgtcgtcgccgtgaagttagttccaattgtgaatgcaacaagtgctaacattcaacagcgttcaaccgaagagcaagcctctgaacgtaaagggggtagcttcggattagggcttttgatggtgcttggtgtactagggttccgtagaaaatagggatttttgtcaggaagggcacaagctcacagatttgggtttgtgccttttttattgcttgagaaaggcgaataattgatcgattctgtattggtgtggtcataaaagatccacacaagtttaatagttgtacgttacaccaaagttaccgtatgaggacagaactatgaagagacaaaagcgtgatcgcctagaaagagctcaatcgcaaggatacaaagccggtctaaacggtcgatcccatgacgaatgtccctatcaacagacggaagtacgctcttattggttaggtggttggcgtgatgctagaaacgataaactttctggtctctgcaaataatttcccatacaacaaagcttgaaaaggcttatcgctaggaaaacagcccgaaacgggctgttattcgttagagattctatctttaaaacgcagacgtatcttggaacaagccaactttaagatctttggctacgtatatttctttgccatcaacaagtacgcgaccatcggctaaacccatcactagcttacggttcaccacacgcttcatgttaatttcgtaggtgacttttttagctgttggtaaaatttgtcctgtaaatttcacttcgccaacgccaagcgcgcgacctttacctttaccgccaacccagccaaggaaaaaacccaccagttgccacatggcatctaagcccaagcatcccggcatcactgggtctcctgggaaatggcaatcaaaaaaccataaatcaggcgtgatatcgagctcagctaagatcaaacctttaccaaattcaccttcagtttctgacatcttggtaatgcgatccatcatcaacatatttggcgctggaagttgaggatagccctcaccaaacaactcaccttggcttgacgctaaaagatcttctcgattatacgaatcacgtttgttctgcattattggttactccattttttgttgggtgcatgttagtgaacacgtgtacgccaaacaactccgatcagtgccagctaagccagtttttgatccgttccacaattccgtgcggttgcacaagtttttcaaaattatcaattctttcagcgatctttgcgatcacgctgtcttcatcttctccacggaaaggtttacccatgagaagaggaatcgcttcatccaccgtcgaaacaggccagatgttgaattcaccattcttaatgctttctactactgatttatgaagcgccaagtgtttcaggttcgaacttggcaaaatcaccccctgttctccagttaagccttggtgacaacagacgcgataaaatccttcaattttttcattcagaccaccgaccgcttgaactcgtccaaattggtcaacagcgccagtaacggcaatctgttggtcaatcggatactcagaaagcgcactcactaatgaacataattccgccagtgaagcgctatcaccatcaacttcactataagactgctcaaaaacaatcgaagcagaaaagggcagagaaccatcaagattcaaggcactactcacaaaagcttgcataatcatcatacctttagcatgaaggttgccgcctaactcaacttttctctctacatccgcaatgtcaccatcaccaaaatggatcacacaggaaattcgagctggctcaccgtaaggcattgggtgcccagtgacttcgatgactgtcaagccattaacttgcccgacttgttcaccctgggtttcgatgatcacttgaccgtcaagaatgtcgtctagagctctttcgggtaaataagactcgcgcagatagcgtttatctaaagcaatttcaatatgttcagcgtcaatcaacggctcttcagattcaaggcgagcttcttcaagtagcgctcgatgccacattaaacaaaggggagcgta

(The sequence listing continues in the following parts.)

What is claimed is:

1. A genetically engineered *Vibrio cholerae* bacterium comprising:
   (a) a deletion in a nucleic acid sequence encoding a cholera toxin subunit A wherein the deletion renders the bacterium incapable of expressing the cholera toxin subunit A;
   (b) a heterologous nucleic acid sequence encoding a Cas9 nuclease molecule, wherein the Cas9 nuclease molecule is integrated into the genome of the bacterium;
   (c) a heterologous nucleic acid sequence encoding a guide RNA (gRNA), wherein the gRNA comprises a targeting domain which is complementary with a target nucleic acid sequence of ctxA;
   (d) a deletion in a nucleic acid sequence encoding a multifunctional-autoprocessing repeats-in-toxin (MARTX) toxin, wherein the deletion renders the bacterium incapable of producing the MARTX toxin;
   (e) a deletion in a nucleic acid encoding a flagellin, wherein the deletion renders the bacterium incapable of producing the flagellin; and
   (f) a deletion in a nucleic acid sequence encoding a RecA protein, wherein the deletion renders the bacterium incapable of producing RecA, wherein the bacterium is derived from a parental strain belonging to the El Tor biotype.

2. The genetically engineered *Vibrio cholerae* bacterium of claim 1, wherein the deletion in the nucleic acid sequence encoding the cholera toxin subunit A is located in a ctxA gene that was integrated into the genome of the bacterium.

3. The genetically engineered *Vibrio cholerae* bacterium of claim 1, wherein the bacterium comprises a deletion in a nucleic acid sequence of the core region of a CTXΦ genome that was integrated into the genome of the bacterium.

4. The genetically engineered *Vibrio cholerae* bacterium of claim 1, wherein the bacterium comprises a deletion in a nucleic acid sequence of the RS2 region of a CTXΦ genome that was integrated into the genome of the bacterium.

5. The genetically engineered *Vibrio cholerae* bacterium of claim 1, wherein the bacterium comprises a complete deletion of a CTXΦ genome that was integrated into the genome of the bacterium.

6. The genetically engineered *Vibrio cholerae* bacterium of claim 1, wherein the gRNA comprises the nucleic acid sequence 5'-cctgatgaaataaagcagtcgttttagagctagaaat agcaagt-taaaataaggctagtccgttatcaacttgaaaaagtggcaccgagtcggtgc-3' (SEQ ID NO: 3).

7. The genetically engineered *Vibrio cholerae* bacterium of claim 1, wherein the nucleic acid sequence encoding the MARTX toxin is selected from the group consisting of rtxA, rtxB, rtxC, rtxD, and rtxE.

8. The genetically engineered *Vibrio cholerae* bacterium of claim 1, wherein the bacterium further comprises a deletion in a nucleic acid sequence encoding a DNA-binding protein HU-beta.

9. The genetically engineered *Vibrio cholerae* bacterium of claim 8, wherein the nucleic acid sequence encoding the DNA-binding protein HU-beta is a hupB gene.

10. The genetically engineered *Vibrio cholerae* bacterium of claim 1, wherein the nucleic acid sequence encoding a flagellin is selected from the group consisting of flaA, flaB, flaC, flaD, and FlaE.

11. The genetically engineered *Vibrio cholerae* bacterium of claim 1, wherein the bacterium comprises a heterologous nucleic acid, wherein the heterologous nucleic acid comprises a gene encoding cholera toxin subunit B that is operably-linked to a promoter.

12. The genetically engineered *Vibrio cholerae* bacterium of claim 11, wherein the gene encoding cholera toxin subunit B is a ctxB gene.

13. The genetically engineered *Vibrio cholerae* bacterium of claim 11, wherein the promoter is a $P_{htpg}$ promoter.

14. The genetically engineered *Vibrio cholerae* bacterium of claim 1, wherein the bacterium is derived from a Haiti parental strain, and/or is Inaba serotype, Ogawa serotype, or Hikojima serotype.

15. A pharmaceutical composition comprising the genetically engineered *Vibrio cholerae* bacterium of claim 1 and a pharmaceutically acceptable excipient.

16. The genetically engineered *Vibrio cholerae* bacterium of claim 1, wherein the bacterium comprises deletion of a dfrA gene, wherein the dfrA gene encodes a product that confers resistance to trimethoprim, and wherein the deletion prevents dispersal of the dfrA gene to other bacteria.

17. The genetically engineered *Vibrio cholerae* bacterium of claim 1, wherein the bacterium comprises deletion of a sul2 gene, wherein the sul2 gene encodes a product that confers resistance to sulfamethoxazole, and wherein the deletion prevents dispersal of the sul2 gene to other bacteria.

18. The genetically engineered *Vibrio cholerae* bacterium of claim 1, wherein the bacterium comprises deletion of a strAB gene, wherein the strAB gene encodes a product that confers resistance to streptomycin, and wherein the deletion prevents dispersal of the strAB gene to other bacteria.

19. The genetically engineered *Vibrio cholerae* bacterium of claim 1, wherein the bacterium comprises deletion of a floR gene, wherein the floR gene encodes a product that confers resistance to chloramphenicol, and wherein the deletion prevents dispersal of the floR gene to other bacteria.

20. The genetically engineered *Vibrio cholerae* bacterium of claim 1, wherein the deletion in the nucleic acid sequence encoding the cholera toxin subunit A is in a nucleic acid sequence of the core region of a CTXΦ genome that was integrated into the genome of the bacterium, and wherein the deletion protects against toxigenic reversion by preventing chromosomal integration of CTXΦ.

* * * * *